(12) United States Patent
Matsuda et al.

(10) Patent No.: US 7,629,453 B2
(45) Date of Patent: Dec. 8, 2009

(54) NF-κB ACTIVATING GENE

(75) Inventors: Akio Matsuda, Fuji (JP); Goichi Honda, Fuji (JP); Shuji Muramatsu, Fuji (JP); Yukiko Nagano, Numazu (JP)

(73) Assignee: Asahi Kasei Pharma Corporation, Chiyoda-Ku (JP)

( * ) Notice: Subject to any disclaimer, the term of this patent is extended or adjusted under 35 U.S.C. 154(b) by 439 days.

(21) Appl. No.: 11/650,501

(22) Filed: Jan. 8, 2007

(65) Prior Publication Data

US 2007/0105198 A1 May 10, 2007

Related U.S. Application Data

(60) Division of application No. 10/617,217, filed on Jul. 11, 2003, now Pat. No. 7,227,007, which is a continuation-in-part of application No. 10/042,211, filed on Jan. 11, 2002, now abandoned, which is a continuation of application No. PCT/JP01/11389, filed on Dec. 25, 2001, said application No. 10/617,217 is a continuation-in-part of application No. 10/024,298, filed on Dec. 21, 2001, now abandoned.

(60) Provisional application No. 60/314,385, filed on Aug. 24, 2001, provisional application No. 60/278,640, filed on Mar. 26, 2001, provisional application No. 60/258,315, filed on Dec. 28, 2000.

(30) Foreign Application Priority Data

| Dec. 28, 2000 | (JP) | ............................. 2000-402288 |
| Mar. 26, 2001 | (JP) | ............................. 2001-088912 |
| Aug. 24, 2001 | (JP) | ............................. 2001-254018 |

(51) Int. Cl.
- *C07H 21/02* (2006.01)
- *C12N 15/12* (2006.01)
- *C12Q 1/68* (2006.01)
- *C07K 14/47* (2006.01)

(52) U.S. Cl. .................. 536/23.5; 530/350; 435/6; 435/69.1; 435/320.1; 436/501

(58) Field of Classification Search .................. None
See application file for complete search history.

(56) References Cited

U.S. PATENT DOCUMENTS

| 5,872,237 A | 2/1999 | Feder et al. |
| 6,812,339 B1 * | 11/2004 | Venter et al. ............ 536/24.31 |
| 7,250,291 B1 * | 7/2007 | Dranoff et al. ............ 435/325 |

2002/0012966 A1   1/2002   Shi et al.

FOREIGN PATENT DOCUMENTS

| JP | 2001-128687 | 5/2001 |
| WO | WO-97/18825 A1 | 5/1997 |
| WO | WP-98/14466 A1 | 4/1998 |
| WO | WO-98/46757 A2 | 10/1998 |
| WO | WO-98/50550 A1 | 11/1998 |
| WO | WO-00/04140 A1 | 1/2000 |
| WO | WO-00/55174 A1 | 9/2000 |
| WO | WO-00/55350 A1 | 9/2000 |
| WO | WO-00/55351 A1 | 9/2000 |
| WO | WO-00/59933 A2 | 10/2000 |
| WO | WO-01/44471 A1 | 6/2001 |

OTHER PUBLICATIONS

Nagase et al., DNA Research 6, 63-70 (1999).
Hirosawa et al., DNA Research 6, 329-336 (1999).
Nagase et al., DNA Research 5, 277-286 (1998).
Nagase et al., DNA Research 6, 337-345 (1999).
Ruddy et al., Genome Research, 7(5), 441-456 (1997).
Faber et al., Human Molecular Genetics, 7(9) 1463-1474 (1998).
Database Uniprot Online, Database accession No. Q9UNZ3, XP002275355, May 13, 2000.
Database EMBL Online, Database accession No. EM_PRO:AC010226, XP002304164, Sep. 17, 1999.
Database EMBL Online, Database accession No. EM_PRO:BE502913, XP002304174, Aug. 7, 2000.
Database EMBL Online, Database accession No. GSP:AAB70084, XP002304161, May 14, 2001.
Database EMBL Online, Database accession No. GSP:ABG65505, XP002304163, Aug. 27, 2002.
Matsuda A., et al., "Large-scale identification and characterization of human genes that activate NF-kappaβ and MAPK signaling pathways," Oncogene, vol. 22, No. 21 (May 2003) pp. 3307-3318, XP002297871.

* cited by examiner

*Primary Examiner*—Lorraine Spector
*Assistant Examiner*—Elly-Gerald Stoica
(74) *Attorney, Agent, or Firm*—Birch Stewart Kolasch & Birch, LLP

(57) ABSTRACT

Provided are proteins having NF-κB activity, which are used for diagnosing, treating or preventing diseases associated with the excessive activation or inhibition of NF-κB. Using plasmid pNF κB-Luc, cDNA encoding a protein capable of activating NF-κB has been cloned from a cDNA library constructed from human lung fibroblasts, and the DNA sequence and the deduced amino acid sequence determined. The protein, the DNA encoding the protein, a recombinant vector containing the DNA, and a transformant containing the recombinant vector are useful for screening a substance inhibiting or promoting NF-κB activation.

9 Claims, 29 Drawing Sheets

NF-κB ACTIVATING GENE

CROSS REFERENCE TO RELATED APPLICATIONS

This application is a Divisional of application Ser. No. 10/617,217 filed on Jul. 11, 2003 now U.S. Pat. No. 7,227,007, which is a continuation-in-part of application Ser. No. 10/042,211 filed on Jan. 11, 2002 and now abandoned, which is a continuation of PCT/JP01/11389 having an international filing date of Dec. 25, 2001, which designated the United States of America. Application Ser. Nos. 10/617,217 and 10/042,211 are also each a continuation-in-part of application Ser. No. 10/024,298 filed on Dec. 21, 2001 and now abandoned, which claims priority under 35 U.S.C. § 119 (e) on U.S. Provisional Application Nos. 60/258,315 filed on Dec. 28, 2000; 60/278,640 filed on Mar. 26, 2001; and 60/314,385 filed on Aug. 24, 2001. This application also claims priority under 35 U.S.C. § 119 (a) on Japanese Application Nos. 402288/2000 filed Dec. 28, 2000; 088912/2001 filed on Mar. 26, 2001; and 254018/2001 filed on Aug. 24, 2001. The entire contents of all of the above-identified applications are hereby incorporated by reference.

TECHNICAL FIELD

The present invention relates to a protein capable of activating NF-κB, a DNA sequence encoding the protein, a method for obtaining the DNA, a recombinant vector containing the DNA, a transformant containing the recombinant vector, and an antibody which specifically reacts with the protein. The present invention also relates to use of the protein, DNA molecule or antibody of the invention in the diagnosis, treatment or prevention of diseases associated with the excessive activation or inhibition of NF-κB.

The present invention also relates to a method for screening a substance capable of inhibiting or promoting NF-κB activation by using the protein, DNA, recombinant vector and transformant.

BACKGROUND ART

The transcription factor NF-κB (nuclear factor kappa B) plays an important role in the transcriptional regulation of various genes involved in inflammation and immunological reactions. NF-κB is a homo- or heterodimer protein which belongs to the Rel family. In unstimulated conditions, NF-κB normally resides in the cytoplasm as an inactive form by forming a complex with an IκB inhibitory protein (Inhibitor of NF-κB) to mask the nuclear transport signal of NF-κB.

When cytokines such as interleukin (IL)-1 and tumor necrosis factor (TNF)-α stimulate cells, IκB is phosphorylated by IKK (IκB kinase) and degraded by the 26S proteasome through ubiquitination. The released NF-κB moves to the nucleus, where it binds to the DNA sequence called the NF-κB binding sequence and induces the transcription of the gene, which is under control of NF-κB is believed to regulate the expression of genes such as those for immunoglobulins, inflammatory cytokines (e.g., IL-1 and TNF-α), interferons and cell adhesion factors. NF-κB is involved in inflammation and immune responses through the expression induction of these genes.

The inhibition of the function or activation of NF-κB may inhibit the expression of many factors (proteins) involved in inflammatory or immunological diseases or other diseases such as tumor proliferation. Thus, NF-κB is a promising target for medicaments against diseases caused or characterized by autoimmunity or inflammation [see e.g., Clinical Chemistry 45, 7-17 (1999); J Clin. Pharmacol. 38, 981-993 (1998); Gut 43, 856-860 (1998); The New England Journal of Medicine 366, 1066-1071 (1997); TiPS 46-50 (1997); The FASEB Journal 9, 899-909 (1995); Nature 395, 225-226 (1998); Science 278, 818-819 (1997); Cell 91, 299-302 (1997)].

Extracellular information is converted into a certain signal, which passes through the cell membrane and goes through the cytoplasm to the nucleus, where it regulates the expression of the target gene and causes cell responses. Therefore the elucidation of the mechanism of intracellular signal transduction from extracellular stimuli to NF-κB activation is of very important significance, because it provides very important means of developing new medicaments or therapies against autoimmune diseases and diseases exhibiting inflammatory symptoms.

It is believed that the signal transduction pathway from certain cell stimulation to NF-κB activation includes many steps mediated by various transmitters such as protein kinases. Therefore it is desirable for more efficient drug discovery to identify the transmitters which play a key role in the pathway, and to focus research on the transmitters to establish a new drug-screening method. Some signaling molecules involved in NF-κB activation have been identified [e.g., IKK, ubiquitination enzymes and the 26S proteasome described above, as well as TNF receptor associated factor 2 (TRAF2) and NF-κB inducing kinase (NIK)]. However, most of the mechanism of NF-κB activation remains unknown, and it has been desired new signaling molecules to be identified and further the NF-κB activation mechanism to be elucidated.

DISCLOSURE OF THE INVENTION

The object of the present invention is to identify a new gene and protein capable of directly, or indirectly, activating NF-κB, and to provide a method of use of them in medicaments, diagnostics and therapy. That is, the present invention provides a new protein capable of activating NF-κB, a DNA sequence encoding the protein, a recombinant vector containing the DNA, a transformant containing the recombinant vector, a process for producing the protein, an antibody directed against the protein or a peptide fragment thereof, and a process for producing the antibody.

The present invention also provides a method for screening a substance capable of inhibiting or promoting NF-κB activation, a kit for the screening, a substance capable of inhibiting or promoting NF-κB activation obtainable by the screening method or the screening kit, a process for producing the substance, a pharmaceutical composition containing a substance capable of inhibiting or promoting NF-κB activation, etc.

Recently, random analysis of cDNA molecules has been intensively carried out to analyze various genes, which are expressed in vivo. The cDNA fragments thus obtained have been entered for databases and published as ESTs (Expressed Sequence Tags, e.g., the database of published sequences provided by the National Center for Biotechnology Information). However, ESTs are merely sequence information, and it is difficult to predict their functions. ESTs are also arranged in the UniGene database, and about 92,000 clusters have been registered until now. However, most of these ESTs have their 5' end nucleotide sequences deleted, and contain no translation initiation site. Therefore it is unlikely that such analysis will directly lead to gene functional analysis such as the analysis of protein functions on the assumption of the determination of mRNA coding regions and the understanding of gene expression control by the analysis of promoters.

On the other hand, one method to elucidate functions of gene products (i.e., proteins) is transient expression cloning method using animal cells [see e.g., "Idenshi Kougaku Handbook (Genetic Engineering Handbook)", an extra issue of "Jikken Igaku (Experimental Medicine)", YODOSHA CO., LTD.]. This method involves transfecting animal cells with a cDNA library constructed using an animal cell expression vector to directly express a functional protein, and identifying and cloning the cDNA based on the biological activity of the protein having an effect on the cells. This method requires no chemical information (amino acid sequences and molecular weights) regarding the target protein product as a prerequisite, and allows the identification of cDNA clones by detecting specific biological activity of the protein expressed in the cells or culture.

For the efficient expression cloning, there is a need to devise a method of preparing a cDNA library. Several methods have been widely used to construct cDNA libraries [e.g., the method of Gubbler-Hoffman: Gene 25 (1983); and the method of Okayama-Berg: Mol. Cell. Biol. 2 (1982)]. However, most of the cDNA molecules prepared by these methods have their 5' end nucleotide sequences deleted, and thus these methods rarely produce full-length cDNA, a complete DNA copy of mRNA. This is because the reverse transcriptase used to prepare cDNA from mRNA does not necessarily have high efficiency in producing full-length cDNA. Therefore it is necessary to improve these prior art methods in order to efficiently carry out the above expression cloning.

In addition, in order to carry out the functional analysis of genes, it is essential to clone full-length cDNA sequences and express proteins from them. Therefore, it has been necessary to construct cDNA libraries containing enriched full-length cDNA for efficient expression cloning.

The present inventors have intensively studied to solve the above problems. As a result, the present inventors have succeeded in constructing a full-length cDNA library by using the oligo-capping method; establishing a gene function assay system by expression cloning using 293-EBNA cells; and isolating a new DNA (cDNA) encoding a protein having a function of activating NF-κB by using the assay system. This new DNA molecule induced NF-κB activation by its expression in 293-EBNA cells. This result shows that this new DNA is a signal transduction molecule involved in NF-κB activation. Thus, the present invention has been completed.

That is, the present invention relates to:

(1) A purified protein selected from the group consisting of:

(a) a protein that activates NF-κB which consists of an amino acid sequence represented by any one of SEQ ID NOS.: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178, and 180; and (b) a protein that activates NF-κB and consists of an amino acid sequence having at least one amino acid deletion, substitution or addition in an amino acid sequence represented by any one of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180.

(2) A purified protein that activates NF-κB and comprises an amino acid sequence having at least 50% identity to the protein according to above item (1) over the entire length thereof.

(3) An isolated polynucleotide which comprises a nucleotide sequence encoding a protein selected from the group consisting of:

(a) a protein which comprises an amino acid sequence represented by any one of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180; and (b) a protein that activates NF-κB and consists of an amino acid sequence having at least one amino acid deletion, substitution or addition in an amino acid sequence represented by any one of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180.

(4) An isolated polynucleotide comprising a polynucleotide sequence selected from the group consisting of:

(a) a polynucleotide sequence represented by any one of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179;

(b) a polynucleotide sequence encoding a protein that activates NF-κB and hybridizing under stringent conditions with a polynucleotide having a polynucleotide sequence complementary to the polynucleotide sequence of (a); and (c) a polynucleotide sequence which encodes a protein that activates NF-κB and consists of a polynucleotide sequence having at least one nucleotide deletion, substitution or addition in a polynucleotide sequence represented by any one of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179.

(5) An isolated polynucleotide comprising a polynucleotide sequence selected from the group consisting of:

(a) a nucleotide sequence represented by a coding region in any one of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179;

(b) a nucleotide sequence encoding a protein that activates NF-κB and hybridizing under stringent conditions with a polynucleotide having a polynucleotide sequence complementary to the polynucleotide sequence of (a); and (c) a nucleotide sequence which encodes a protein that activates NF-κB and consists of a nucleotide sequence having at least one nucleotide deletion, substitution or addition in a nucleotide sequence represented by a coding region in any one of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179.

(6) An isolated polynucleotide comprising a nucleotide sequence which encodes a protein that activates NF-κB and has at least 95% identity to the polynucleotide sequence according to above item (3) over the entire length thereof.

(7) An isolated polynucleotide comprising a nucleotide sequence which encodes a protein that activates NF-κB and has at least 95% identity to the polynucleotide sequence according to above item (4) or (5) over the entire length thereof.

(8) A purified protein encoded by the polynucleotide according to any one of above items (3) to (7).

(9) A recombinant vector which comprises a polynucleotide according to any one of above items (3) to (7).

(10) A gene therapy agent comprising the recombinant vector according to above item (9) as an active ingredient.

(11) A transformed cell which comprises the recombinant vector according to above item (9).

(12) A membrane of the cell according to above item (11), when the protein according to above item (1) or (2) is a membrane protein.

(13) A process for producing a protein comprising, (a) culturing a transformed cell comprising the isolated polynucleotide according to any one of items (3) to (7) under conditions providing expression of the encoded protein; and (b) recovering the protein from the culture.

(14) A process for diagnosing a disease or a susceptibility to a disease in a subject related to expression or activity of the protein according to above item (1), (2) or (8) in a subject comprising:

(a) determining the presence or absence of a mutation in the nucleotide sequence encoding said protein in the genome of said subject; and/or (b) analyzing the amount of expression of said protein in a sample derived from said subject.

In the above-described method, a diagnosis of disease is preferably made when the amount of the protein expressed is 2-fold or higher than normal, or half or less than normal.

(15) A method for screening a compound in respect of activity to inhibit or promote NF-κB activation, which comprises the steps of:

(a) providing a cell with a gene encoding a protein that activates NF-κB, and a component that provides a detectable signal associated with activation of NF-κB;

(b) culturing a transformed cell under conditions, which permit the expression of the gene in the transformed cell;

(c) contacting the transformed cell with one or more compounds;

(d) measuring the detectable signal; and (e) isolating or identifying an activator compound and/or an inhibitor compound by measuring the detectable signal.

Further, it is preferable to isolate or identify as an activator compound, a compound that increases said detectable signal 2-fold or higher than normal, and to isolate or identify as an inhibitor compound, a compound that decreases said detectable signal half or less than normal.

(16) A process for producing a pharmaceutical composition, which comprises the steps of:

(a) providing a cell with a gene encoding a protein that activates NF-κB, and a component capable of providing a detectable signal;

(b) culturing a transformed cell under conditions, which permit the expression of the gene in the transformed cell;

(c) contacting the transformed cell with one or more candidate compounds;

(d) measuring the detectable signal;

(e) isolating or identifying an activator compound and/or an inhibitor compound by measuring the detectable signal; and (f) optimizing the isolated or identified compound as a pharmaceutical composition.

Further, it is preferable to isolate or identify as an activator compound, a compound that increases said detectable signal 2-fold or higher than normal, and to isolate or identify as an inhibitor compound, a compound that decreases said detectable signal half or less than normal.

(17) A kit for screening a compound in respect of activity to inhibit or promote NF-κB activation, which comprises:

(a) a cell comprising a gene encoding a protein that activates NF-κB, and a component that provides a detectable signal upon activation of NF-κB; and (b) reagents for measuring the detectable signal.

(18) A monoclonal or polyclonal antibody or a fragment thereof that specifically binds to the protein according to above item (1), (2) or (8).

(19) The monoclonal or polyclonal antibody or a fragment thereof according to above item (18) that inhibits the action of activating NF-κB of the protein according to above item (1), (2) or (8).

(20) A process for producing a monoclonal or polyclonal antibody according to above item that specifically binds to the protein of above item (1), (2) or (8), which comprises administering the protein according to above item (1), (2) or (8) as an antigen or epitope-bearing fragments to a non-human animal.

(21) An antisense oligonucleotide complementary to the polynucleotide according to any one of above items (3) to (7), which prevents NF-κB activator protein expression.

(22) A ribozyme which inhibits NF-κB activation by cleavage of RNA that encodes the protein of above item (1), (2) or (8).

(23) A double stranded nucleic acid having a nucleotide sequence corresponding to a part of the nucleotide sequence of the isolated polynucleotide according to any one of above items 3-7, which inhibit the expression of the protein that activates NF-κB.

(24) The double stranded nucleic acid according to above item 23, wherein the nucleic acid has a nucleotide sequence corresponding to a part of the nucleotide sequence represented by SEQ ID NO: 88, and inhibits the expression of the protein having the amino acid sequence represented by SEQ ID NO: 87.

(25) A double stranded nucleic acid obtained by annealing of any one of the following oligonucleotide pairs (a)-(f):

```
                                        (SEQ ID NO: 213)
(a)      5'- GUCCAGGAUAUCAUGAGUCNn -3'
                                        (SEQ ID NO: 214)
         3'- NnCAGGUCCUAUAGUACUCAG -5'

(SEQ ID NO: 215)
(b)      5'- GAAGUCUGAAGAUCUAUCCNn -3'
                                        (SEQ ID NO: 216)
         3'- NnCUUCAGACUUCUAGAUAGG -5'

(SEQ ID NO: 217)
(c)      5'- GCUGAAGAAGAGGUGUUCCNn -3'
                                        (SEQ ID NO: 218)
         3'- NnCGACUUCUUCUCCACAAGG -5'

(SEQ ID NO: 219)
(d)      5'- GAUGACACAGAUGAAGCCCNn -3'
                                        (SEQ ID NO: 220)
         3'- NnCUACUGUGUCUACUUCGGG -5'

(SEQ ID NO: 221)
(e)      5'- GCCCUCAGAGUCCAGAAUCNn -3'
                                        (SEQ ID NO: 222)
         3'- NnCGGGAGUCUCAGGUCUUAG -5'

(SEQ ID NO: 223)
(f)      5'- GAUGACUUUGGUAUCAAACNn -3'
                                        (SEQ ID NO: 224)
         3'- NnCUACUGAAACCAUAGUUUG -5'
``` wherein N represents any one of G, A, T, C, and U, and n is 1 to 4.

It should be noted that "Nn" is not included in each sequence of SEQ ID NOs: 213-224 in the Sequence Listing.

(26) The double stranded nucleic acid according to above item 25, wherein Nn is TT or UU.

(27) A double stranded nucleic acid having one or more mutations in the sense strand of the double strand nucleic acid according to above item (26).

(28) A double stranded nucleic acid comprising the double stranded nucleic acid according to any one of above items (25) to (27) as a part, which inhibits the expression of the protein having the amino acid sequence represented by SEQ ID NO: 87.

(29) An expression vector capable of expressing the double stranded nucleic acid according to above item (25), wherein Nn is UU or UUU.

(30) A method for treating a disease, which comprises administering to a subject an amount of compound screened by the process according to above item (15), and/or a monoclonal or polyclonal antibody or a fragment thereof according to above item (18) or (19), and/or an antisense oligonucleotide according to above item (21) and/or a ribozyme according to above item (22) and/or a double stranded nucleic acid according to any one of above items (23)-(28) and/or the expression vector according to above item (29) effective to treat a disease selected from the group consisting of inflammation, autoimmune diseases, infectious disease, cancers and bone diseases.

(31) A method for treating a disease, which comprises administering to a subject an amount of a compound screened by the process according to above item (15), and/or a monoclonal or polyclonal antibody or a fragment thereof according to above item (18) or (19), and/or an antisense oligonucleotide according to above item (21), and/or a ribozyme according to above item (22) effective to treat a disease selected from the group consisting of inflammation, autoimmune diseases, infectious diseases, cancers and bone diseases.

(32) A pharmaceutical composition produced according to the process of item (16) as an inhibitor or promoter of NF-κB activation.

(33) A pharmaceutical composition according to item (32) for the treatment of inflammation, autoimmune diseases, cancers, infectious diseases, bone diseases, AIDS, neurodegenerative diseases, or ischemic disorders.

(34) A method of treating inflammation, autoimmune diseases, cancers, infectious diseases, bone diseases, AIDS, neurodegenerative diseases, or ischemic disorders, which comprises administering a pharmaceutical composition produced according to the process of above item (16) to a patient suffering from a disease associated with NF-κB.

(35) A pharmaceutical composition which comprises a monoclonal or polyclonal antibody or a fragment thereof according to item (18) or (19) as an active ingredient.

(36) A pharmaceutical composition which comprises an antisense oligonucleotide according to item (21) as an active ingredient.

(37) A pharmaceutical composition which comprises a ribozyme according to above item (22) as an active ingredient.

(38) A pharmaceutical composition or a gene therapy agent which comprises a double stranded nucleic acid according to any one of above items (23) to (28) and/or an expression vextor according to above item (29) as an active ingredient.

(39) An expression inhibiting agent for a protein having an action of activating NF-κB, which comprises a double stranded nucleic acid according to any one of above items (23) to (28) and/or an expression vextor according to above item (29) as an active ingredient.

(40) The pharmaceutical composition according to item (35) or (36), wherein the target disease is selected from the group consisting of inflammation, autoimmune diseases, infectious diseases, cancers, bone diseases, AIDS, neurodegenerative diseases and ischemic disorders.

(41) A method for obtaining a novel gene having a function, which comprises at least the following steps:

(a) constructing a full-length cDNA library by the oligo-capping method;

(b) cotransfecting the full-length cDNA and a plasmid containing a factor emitting a signal indicative of the presence of a protein having the function into cells; and (c) selecting a plasmid emitting the signal.

It should be noted that a novel gene having a function according to the present invention refers to, for example, a nucleic acid molecule encoding a protein having biological function.

(42) A computer-readable medium on which a sequence data set has been stored, said sequence data set comprising at least one nucleotide sequence selected from the group consisting of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179, and/or at least one amino acid sequence selected from the group consisting of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180.

(43) A method for calculating identity to other nucleotide sequences and/or amino acid sequences, which comprises comparing data on a medium according to above item (42) with data of said other nucleotide sequences and/or amino acid sequences.

(44) An insoluble substrate to which polynucleotide comprising all or part of the nucleotide sequences selected from the group consisting of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88 and 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179, are fixed.

(45) An insoluble substrate to which polypeptides comprising all or a part of the amino acid sequences selected from the group consisting of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180, are fixed.

The contents of the specifications and/or drawings of Japanese Patent Applications Nos. 2000-402288, 2001-088912 and 2001-254018, and U.S. Provisional Applications Nos. 60/258,315, 60/278,640 and 60/314,385, which from the bases of priority of the instant application, are incorporated herein.

BEST MODE FOR CARRYING OUT THE INVENTION

Figure 1:
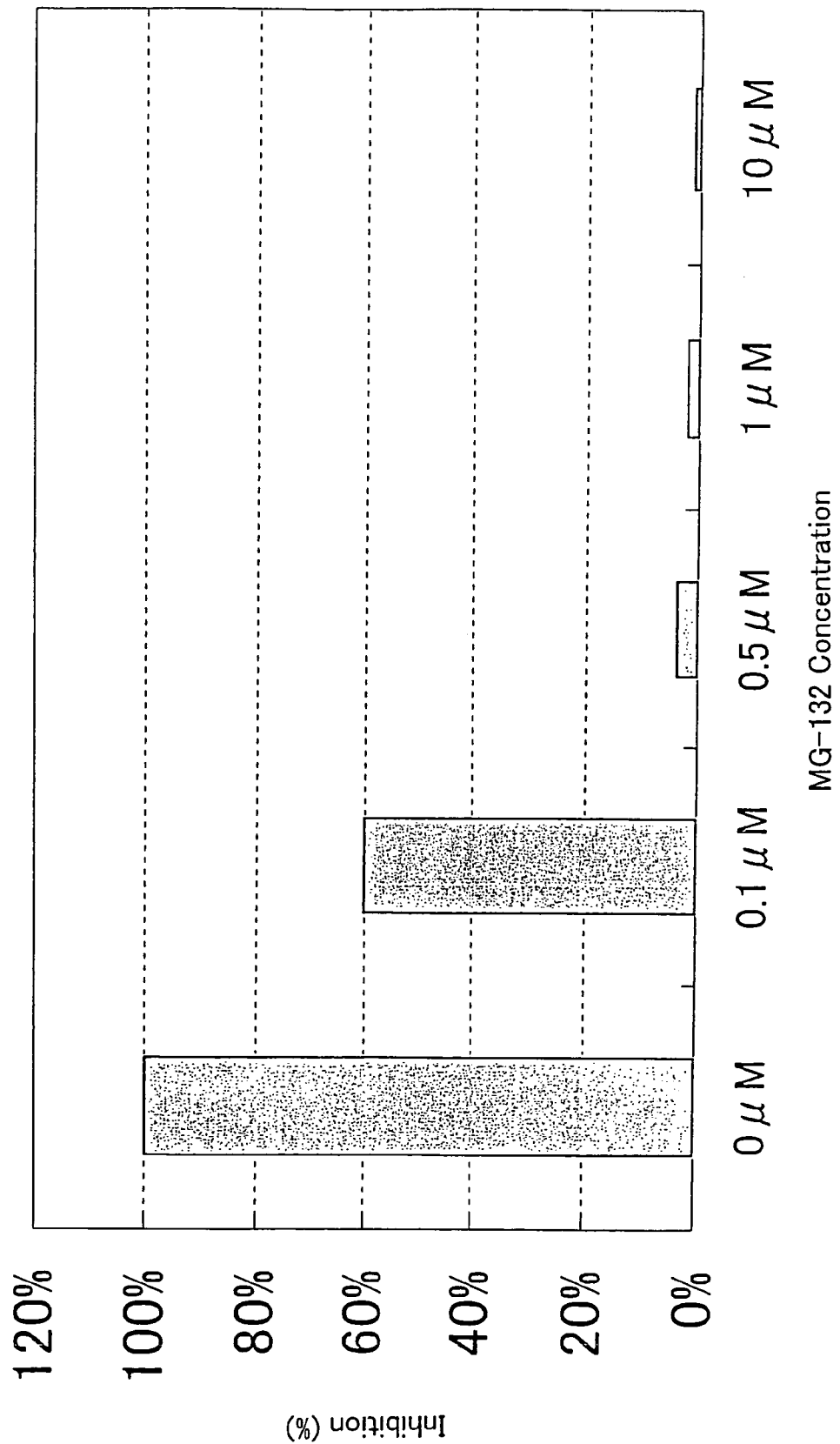
FIG. 1 is a graph showing NF-κB reporter activity inhibition by the proteasome inhibitor MG-132 (SEQ ID NO: 5) in Example 3, the axis of abscissa is MG-132 concentration and the transversal axis is relative luciferase activity where relative luciferase activity is taken as 100% under conditions of non-addition of MG-132 (0 μM). (Relative luciferase activity at various concentrations was divided by relative luciferase activity under conditions of non-addition of MG-132, and expressed as a percentage.)

At first, in order to further clarify the basic feature of the present invention, the present invention is explained by following how the present invention is completed. In order to obtain a new gene having a function of activating NF-κB, the following experiments were carried out as shown in the examples. First, using the oligo-capping method, a full-length cDNA was produced from mRNA prepared from normal human lung fibroblasts (purchased from Sanko Junyaku Co., Ltd.), and a full-length cDNA library was constructed in which the cDNA was inserted into the vector pME18S-FL3 (GenBank Accession AB009864). Next, the cDNA library was introduced into E. coli cells, and plasmid preparation was carried out per clone. Then, the pNK κB-Luc reporter plasmid (STRATAGENE) containing a DNA encoding luciferase under control of a promoter activated by NF-κB and the above full-length cDNA plasmid were cotransfected into 293-EBNA cells (Invitrogen). After 24 or 48 hours of culture, luciferase activity was measured, and the plasmid with significantly increased luciferase activity compared to that of a control experiment (vector pME18S-FL3 is introduced into a cell in place of a full-length cDNA) was selected (the selected plasmid showed a 5-fold or more increase in luciferase activity compared to that of the control experiment), and the entire nucleotide sequence of the cDNA cloned into the plasmid was determined. The protein encoded by the cDNA thus obtained shows that this protein is a signal transduction molecule involved in NF-κB activation.

The present invention is described in detail below.

In the present invention, activation of NF-κB refers to direct or indirect activation of NF-κB (including induction of NF-κB activation) when a gene is introduced into a suitable cell and the protein encoded by the gene is excessively expressed. Activation of NF-κB can be measured, for example, by an assay using an NF-κB dependant reporter gene. In the assay, activation may be reflected by increasing the reporter activity compared to control cells (cells into which the vector only was introduced). Increase in reporter activity is preferably by a factor of 1.5 or more, more preferably by a factor of 2 or more, and still more preferably by a factor of 5 or more.

Reporter activity can be measured by cloning a polynucleotide (e.g. cDNA) encoding the protein to be expressed into a suitable expression vector, co-transfecting the expression vector and an NF-κB dependant reporter plasmid into a suitable cell, and after culturing for a certain period, then measuring reporter activity. Suitable expression vectors are well known to those skilled in the art, examples of which include pME18S-FL3, pcDNA3.1 (Invitrogen). The reporter gene can be one which enables a person skilled in the art to easily detect the expression thereof, and examples include a gene encoding luciferase, chloramphenicol acetyl transferase, or β-galactosidase. Use of a gene encoding luciferase is most preferable, and examples of an NF-κB dependent reporter plasmid include pNF-κB-Luc (STRATAGENE). Suitable cells include cells which exhibit an NF-κB activation response to stimulation by IL-1, TNF-α and the like. Examples include 293-EBNA cells. Cell culture and introduction of genes into cells (transfection) can be performed and optimized by a person skilled in the art by known techniques.

As a preferable method, 293-EBNA cells are inoculated on 5% FBS (Fetal Bovine Serum) containing DMEM medium (Dulbecco's Modified Eagle Medium) in a 96-well cell culture plate to a final cell density of $1 \times 10^4$ cells/well, and cultured for 24 hours at 37° C. in the presence of 5% CO2. Then, reporter plasmid pNF-κB-Luc (STRATAGENE) and the expression vector are cotransfected into the cells in a well using FuGENE 6 (Roche). After 24 hours of culture at 37° C., NF-κB activation is then measured by measuring luciferase activity using a long term luciferase assay system, Picagene LT2.0 (Toyo Ink Mfg). For example, luciferase activity can be measured using PerkinElmer's Wallac ARVOTMST 1420 MULTILABEL COUNTER. The method for gene introduction by FuGENE6, and measurement of luciferase activity by Picagene LT2.0 can be performed respectively according to the attached protocols. In a method of gene introduction with a 96-well plate using FuGENE6, the amount of FuGENE6 per 1 well is suitably 0.3 to 0.5 µl, preferably 0.3 µl; the amount of pNF-κB-Luc plasmid is suitably 50 to 100 ng, preferably 50 ng; the amount of expression vector is suitably 50-100 ng, and preferably 100 ng. An ability to activate NF-κB refers to an ability to increase the reporter activity (luciferase activity) relative to the control experiment (cells into which only a null vector was introduced). Increase in reporter activity is preferably by a factor of 1.5 or more, more preferably by a factor of 2 or more, and still more preferably by a factor of 5 or more.

Related to the amino acid sequences of any one of SEQ ID NOS. 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180, the present invention provides for a protein that:

(a) comprises one of the above amino acid sequences;

(b) is a peptide having one of the above amino acid sequences;

(c) activates NF-κB and consists of an amino acid sequence having at least one amino acid deletion, substitution or addition in the above amino acid sequences;

(d) comprises an amino acid sequence, which has at least 95% identity, preferably at least 97-99% identity, to an amino acid sequence of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 or 180, over the entire length thereof.

"Identity" as known in the art, is a relationship between two or more protein sequence or two or more polynucleotide sequences, as determined by comparing the sequences. In the art, "identity" also means the degree of sequence relatedness between protein or polynucleotide sequences, as determined by the match between protein or polynucleotide sequences, as the case may be, as determined by the match between strings of such sequences. "Identity" and "similarity" can be readily calculated by known methods. Preferred methods to determine identity are designed to give the largest match between the sequences tested. Methods to determine identity and similarity are codified in publicly available computer programs. "Identity" can be determined by using the BLAST program (for example, Altschul S F, Gish W, Miller W, Myers E W, Lipman D J., J. Mol. Biol., 215: p 403-410 (1990), Altschul S F, Madden T L, Schaffer A A, Zhang Z, Miller W, Lipman D J. Nucleic Acids Res. 25: p 3389-3402 (1997)). Where software such as BLAST is used, it is preferable to use default values. The main initial conditions generally used in a BLAST search are as follows, but are not limited to these.

An amino acid substitution matrix is a matrix numerically representing the degree of analogy of each pairing of each of the 20 types of amino acid, and normally the default matrix of BLOSUM62 is used. The theory of this amino acid substitution matrix is shown in Altschul S. F., J. Mol. Biol. 219: 555-565 (1991), and applicability to DNA sequence comparison is shown on States D. J., Gish W., Altschul S. F., Methods, 3: 66-70 (1991). In this case, optimal gap cost is determined by experience and in the case of BLOSUM62 preferably parameters of Existence 11, Extension 1 are used. The expected value (EXPECT) is the threshold value concerning statistical significance for a match with a database sequence, and the default value is 10.

As one example, a protein having, for example, 95% or more identity to the amino acid sequence of SEQ ID NO: 2 may contain in the amino acid sequence up to 5 amino acid changes per 100 amino acids of the amino acid sequence of SEQ ID NO: 2. In other words, a protein having 95% or more amino acid sequence identity to a subject amino acid sequence, may have amino acids up to 5% of the total number of amino acids within the subject sequence, deleted or substituted by other amino acids, or amino acids up to 5% of the total number of amino acids within the subject sequence may be inserted within the subject sequence. These changes within the subject sequence, may exist at the amino terminus or the carboxy terminus of the subject sequence, or may exist at any position between these termini, or may form one or more groups of changes.

The Examples described below demonstrate that the protein consisting of an amino acid sequence of any one of the above SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180, is capable of activating NF-κB.

Related to the polynucleotide sequence of any one of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179, the present invention further provides an isolated polynucleotide that:

(a) comprises a nucleotide sequence, which has at least 95% identity, preferably at least 97-99% identity to any one of the above sequences;

(b) is a polynucleotide of any one of the above sequences; or (c) has a nucleotide sequence encoding a protein which has at least 95% identity, preferably, at least 97-99% identity, to the amino acid sequence of any one of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180.

Polynucleotides which are identical or almost identical to nucleotide sequences contained in the above nucleotide sequences may be used as hybridization probes to isolate full-length cDNA and genomic clones encoding the protein of the present invention, or cDNA or genomic clones of other genes that have a high sequence similarity to the above sequences, or genomic clones, or may be used as primers for nucleic acid amplification reactions. Typically, these nucleotide sequences are 70% identical, preferably 80% identical, more preferably 90% identical, most preferably 95% identical to the above sequences. The probes or primers will generally comprises at least 15 nucleotides, preferably 30 nucleotides and may have 50 nucleotides. Particularly preferred probes will have between 30 and 50 nucleotides. Particularly preferred primers have between 20 and 25 nucleotides.

The polynucleotide of the present invention may be either in the form of a DNA such as cDNA, a genomic DNA obtained by cloning or synthetically produced, or may be in the form of RNA such as mRNA. The polynucleotide may be single-stranded or double-stranded. The double-stranded polynucleotides may be double-stranded DNA, double-stranded RNA or DNA:RNA hybrid. The single-stranded polynucleotide may be sense strand also known as coding strand or antisense strand also known as non-coding strand.

Those skilled in the art can prepare a protein having the same NF-κB activating activity as the protein having an amino acid sequence of any one of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180, by means of appropriate substitution of an amino acid in the protein using known methods. One such method involves using conventional mutagenesis procedures for the DNA encoding the protein. Another method is, for example, site-directed mutagenesis (e.g., Mutan-Super Express Km Kit from Takara Shuzo Co., Ltd.). Mutations of amino acids in proteins may also occur in nature. Thus, the present invention also includes a mutated protein which is capable of activating NF-κB and which has at least one amino acid deletion, substitution or addition relative to the protein of any one of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180, and the DNA encoding the protein. The number of mutations is preferably up to 10, more preferably up to 5, most preferably up to 3.

The substitutions of amino acids are preferably conservative substitutions, specific examples of which are substitutions within the following groups: (glycine, alanine), (valine, isoleucine, leucine), (aspartic acid, glutamic acid), (asparagine, glutamine), (serine, threonine), (lysine, arginine) and (phenylalanine, tyrosine).

Based on the nucleotide sequences (e.g., SEQ ID NO: 2) encoding a protein consisting of an amino acid sequence of any one of SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180 or a fragment thereof, those skilled in the art can routinely isolate a DNA with a high sequence similarity to these nucleotide sequences by using hybridization techniques and the like, and obtain proteins having the same NF-κB activating activity as the protein having of an amino acid sequence of any one of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180. Thus, the present invention also includes a protein that activates NF-κB and comprises an amino acid sequence having a high identity to the amino acid sequence of any one of the above SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180. "High identity" refers to an amino acid sequence having an identity of at least 90%, preferably 95%, and more preferably at least 97% over the entire length of an amino acid sequence expressed by any one of the above SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180. The proteins of the present invention may be natural proteins derived from any human or animal cells or tissues, chemically synthesized proteins, or proteins obtained by genetic recombination techniques. The protein may or may not be subjected to post-translational modifications such as sugar chain addition or phosphorylation.

The present invention also includes a polynucleotide encoding the above protein of the present invention. Examples of nucleotide sequences encoding a protein consisting of an amino acid sequence of any one of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180 include nucleotide sequences of any one of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179. The DNA includes cDNA, genomic DNA, and chemically synthesized DNA. In accordance with the degeneracy of the genetic code, at least one nucleotide in the nucleotide sequence encoding a protein consisting of an amino acid sequence of any one of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180 can be substituted with other nucleotides without altering the amino acid sequence of the protein produced from the gene. Therefore, the DNA sequences of the present invention also include nucleotide sequences altered by substitution based on the degeneracy of the genetic code. Such DNA sequences can be synthesized using known methods.

The DNA of the present invention includes a DNA which encodes a protein capable of activating NF-κB and hybridizes under stringent conditions with the DNA sequence of the above nucleotide sequence of any one of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179. Stringent conditions are apparent to those skilled in the art, and can be easily attained in accordance with various laboratory manuals such as T. Maniatis et al., Molecular Cloning A Laboratory Manual, Cold Spring Harbor Laboratory 1982, 1989.

That is, "stringent conditions" refer to overnight incubation at 37° C. in a hybridization solution containing 30% formamide, 5×SSC (0.75 M NaCl, 75 mM trisodium citrate), 5×Denhardt's solution, 0.5% SDS, 100 µg/ml denatured, sheared salmon sperm DNA) followed by washing (three times) in 2×SSC, 0.1% SDS for 10 minutes at room temperature, then followed by washing (two times) in 0.2×SSC, 0.1% SDS for 10 minutes at 37° C. (low stringency). Preferred stringent conditions are overnight incubation at 42° C. in a hybridization solution containing 40% formamide, followed by washing (three times) in 2×SSC, 0.1% SDS for 10 minutes at room temperature, then followed by washing (two times) in 0.2×SSC, 0.1% SDS for 10 minutes at 42° C. (moderate stringency). More preferred stringent conditions are overnight incubation at 42° C. in a hybridization solution containing 50% formamide, followed by washing (three times) in 2×SSC, 0.1% SDS for 10 minutes at room temperature, followed by washing (two times) in 0.2×SSC, 0.1% SDS for 10 minutes at 50° C. (high stringency). The DNA sequence thus obtained must encode a protein capable of activating NF-κB.

The present invention also includes a polynucleotide comprising a nucleotide sequence which encodes a protein capable of activating NF-κB and has a high sequence similarity to the nucleotide sequence of the polynucleotide according to above item (3) or (4). Typically these nucleotide sequence are 95% identical, preferably 97% identical, more preferably 98-99% identical, most preferably at least 99% identical to the nucleotide sequence of the polynucleotide according to above item (3) or (4) over the entire length thereof.

The above nucleotide sequence of the present invention can be used to produce the above protein using recombinant DNA techniques. In general, the DNA and peptide of the present invention can be obtained by:

(A) cloning the DNA encoding the protein of the present invention;

(B) inserting the DNA encoding the entire coding region of the protein or a part thereof into an expression vector to construct a recombinant vector;

(C) transforming host cells with the recombinant vector thus constructed; and (D) culturing the obtained cells to express the protein or its analogue, and then purifying it by column chromatography.

General procedures necessary to handle DNA and recombinant host cells (e.g., E. coli) in the above steps are well known to those skilled in the art, and can be easily carried out in accordance with various laboratory manuals such as T. Maniatis et al., supra. All the enzymes, reagents, etc., used in these procedures are commercially available, and unless otherwise stated, such commercially available products can be used according to the use conditions specified by the manufacturer's instructions to attain completely its objects. The above steps (A) to (D) can be further illustrated in more details as follows.

Techniques for cloning the DNA encoding the protein of the present invention include, in addition to the methods described in the specification of the present application, PCR amplification using a synthetic DNA having a part of the nucleotide sequence of the present invention (e.g., any one of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179) as a primer, and selection of the DNA inserted into a suitable vector by hybridization with a labeled DNA fragment encoding a partial or full coding region of the protein of the present invention or a labeled synthetic DNA. Another technique involves direct amplification from total RNAs or mRNA fractions prepared from cells or tissues, using the reverse transcriptase polymerase chain reaction (RT-PCR method). As a DNA inserted into a suitable vector, for example, a commercially available library (e.g., from CLONTECH and STRATAGENE) can be used. Techniques for hybridization are normally used in the art, and can be easily carried out in accordance with various laboratory manuals such as T. Maniatis et al., supra. Depending on the intended purpose, the cloned DNA encoding the protein of the present invention can be used as such or if desired after digestion with a restriction enzyme or addition of a linker. The DNA thus obtained may have a nucleotide sequence of any one of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179, or a polynucleotide of above items (3) to (7). The DNA sequence to be inserted into an expression vector in the above step (B) may be a full-length cDNA or a DNA fragment encoding the above full-length protein, or a DNA fragment constructed so that it expresses a part thereof.

Thus, the present invention also includes a recombinant vector, which comprises the above DNA sequence. The expression vector for the protein of the present invention can be produced, for example, by excising the desired DNA fragment from the DNA encoding the protein of the present invention, and ligating the DNA fragment downstream of a promoter in a suitable expression vector.

Expression vectors for use in the present invention may be any vectors derived from prokaryotes (e.g., E. coli), yeast, fungi, insect viruses and vertebrate viruses so long as such vectors are replicable. However, the vectors should be selected to be compatible with microorganisms or cells used as hosts. Suitable combinations of host cell-expression vector systems are selected depending on the desired expression product.

When microorganisms are used as hosts, plasmid vectors compatible with these microorganisms are generally used as replicable expression vectors for recombinant DNA molecules.

For example, the plasmids pBR322 and pBR327 can be used to transform E. coli. Plasmid vectors normally contain an origin of replication, a promoter, and a marker gene conferring upon a recombinant DNA a phenotype useful for selecting the cells transformed with the recombinant DNA. Example of such promoters include a β-lactamase promoter, lactose promoter and tryptophan promoter. Examples of such marker genes include an ampicillin resistance gene, and a tetracycline resistance gene. Examples of suitable expression vectors include the plasmids pUC18 and pUC19 in addition to pBR322, pBR327.

In order to express the DNA of the present invention in yeast, for example, YEp24 can be used as a replicable vector. The plasmid YEp24 contains the URA3 gene, which can be employed as a marker gene. Examples of promoters in expression vectors for yeast cells include promoters derived from genes for 3-phosphoglycerate kinase, glyceraldehyde-3-phosphate dehydrogenase and alcohol dehydrogenase.

Examples of promoters and terminators for use in expression vectors to express the DNA of the present invention in fungal cells include promoters and terminators derived from genes for phosphoglycerate kinase (PGK), glyceraldehyde-3-phosphate dehydrogenase (GAPD) and actin. Examples of suitable expression vectors include the plasmids pPGACY2 and pBSFAHY83.

Examples of promoters for use in expression vectors to express the DNA of the present invention in insect cells include a polyhedrin promoter and P10 promoter.

Recombinant vectors used to express the DNA of the present invention in animal cells normally contain functional sequences to regulate genes, such as an origin of replication, a promoter to be placed upstream of the DNA of the present invention, a ribosome-binding site, a polyadenylation site and a transcription termination sequence. Such functional sequences, which can be used to express the DNA of the present invention in eukaryotic cells, can be obtained from viruses and viral substances. Examples of such functional sequences include an SR α promoter, SV40 promoter, LTR promoter, CMV (cytomegalovirus) promoter and HSV-TK promoter. Among them, a CMV promoter and SR α promoter can be preferably used. As promoters to be placed inherently upstream of the gene encoding the protein of the present invention, any promoters can be used so long as they are suitable for use in the above host-vector systems. Examples of origins of replication include foreign origins of replication, for example, those derived from viruses such as adenovirus, polyoma virus and SV40 virus. When vectors capable of integration into host chromosomes are used as expression vectors, origins of replication of the host chromosomes may be employed. Examples of suitable expression vectors include the plasmids pSV-dhfr (ATCC 37146), pBPV-1(9-1) (ATCC 37111), pcDNA3.1 (INVITROGEN) and pME18S-FL3.

The present invention also includes a transformed cell, which comprises the above recombinant vector.

Microorganisms or cells transformed with the replicable recombinant vector of the present invention can be selected from remaining untransformed parent cells based on at least one phenotype conferred by the recombinant vector. Phenotypes can be conferred by inserting at least one marker gene into the recombinant vector. Marker genes naturally contained in replicable vectors can be employed. Examples of marker genes include drug resistance genes such as neomycin resistance genes, and genes encoding dihydrofolate reductase.

As hosts for use in the above step (C), any of prokaryotes (e.g., *E. coli*), microorganisms (e.g., yeast and fingi) as well as insect and animal cells can be used so long as such hosts are compatible with the expression vectors used. Examples of such microorganisms include *Escherichia coli* strains such as *E. coli* K12 strain 294 (ATCC 31446), *E. coli* X1776 (ATCC 31537), *E. coli* C600, *E. coli* JM109 and *E. coli* B strain; bacterial strains belonging to the genus *Bacillus* such as *Bacillus subtilis*; intestinal bacteria other than *E. coli*, such as *Salmonella typhimurium* or *Serratia marcescens*; and various strains belonging to the genus *Pseudomonas*. Examples of such yeast include *Saccharomyces cerevisiae*, *Schizosaccharomyces pombe*, and *Pichia pastoris*. Examples of such fungi include *Aspergillus nidulans*, and *Acremonium chrysogenum* (ATCC 11550).

As insect cells, for example, *Spodoptera frugiperda* (Sf cells), High Five TM cells derived from eggs of *Trichoplusiani*, etc., can be used when the virus is AcNPV. Examples of such animal cells include HEK 293 cells, COS-1 cells, COS-7 cells, Hela cells, and Chinese hamster ovary (CHO) cells. Among them, CHO cells and HEK 293 cells are preferred.

When cells are used as hosts, combinations of expression vectors and host cells to be used vary with experimental objects. According to such combinations, two types of expression (i.e. transient expression and constitutive expression) can be included.

"Transformation" of microorganisms and cells in the above step (C) refers to introducing DNA into microorganisms or cells by forcible methods or phagocytosis of cells and then transiently or constitutively expressing the trait of the DNA in a plasmid or an intra-chromosome integrated form. Those skilled in the art can carry out transformation by known methods [see e.g., "Idenshi Kougaku Handbook (Genetic Engineering Handbook)", an extra issue of "Jikken Igaku (Experimental Medicine)", YODOSHA CO., LTD.]. For example, in the case of animal cells, DNA can be introduced into cells by known methods such as DEAE-dextran method, calcium-phosphate-mediated transfection, electroporation, lipofection, etc. For stable expression of the protein of the present invention using animal cells, there is a method in which selection can be carried out by clonal selection of the animal cells containing the chromosomes into which the introduced expression vectors have been integrated. For example, transformants can be selected using the above selectable marker as an indication of successful transformation. In addition, the animal cells thus obtained using the selectable marker can be subjected to repeated clonal selection to obtain stable animal cell strains highly capable of expressing the protein of the present invention. When a dihydrofolate reductase (DHFR) gene is used as a selectable marker, one can culture animal cells while gradually increasing the concentration of methotrexate (MTX) and select the resistant strains, thereby amplifying the DNA encoding the protein of the present invention together with the DHFR gene to obtain animal cell strains having higher levels of expression.

The above transformed cells can be cultured under conditions which permit the expression of the DNA encoding the protein of the present invention to produce and accumulate the protein of the present invention. In this manner, the protein of the present invention can be produced. Thus, the present invention also includes a process for producing a protein, which comprises culturing a transformed cell comprising the isolated polynucleotide according to above item (3) to (7) under conditions providing expression of the encoded protein and recovering the protein from the culture.

The above transformed cells can be cultured by methods known to those skilled in the art (see e.g., "Bio Manual Series 4", YODOSHA CO., LTD.). For example, animal cells can be cultured by various known animal cell culture methods including attachment culture such as Petri dish culture, multitray type culture and module culture, attachment culture in which cells are attached to cell culture carriers (microcarriers), suspension culture in which productive cells themselves are suspended. Examples of media for use in the culture include media commonly used for animal cell culture, such as D-MEM and RPMI 1640.

In order to separate and purify the protein of the present invention from the above culture, suitable combinations of per se known separation and purification methods can be used. Examples such methods include methods based on solubility, such as salting-out and solvent precipitation; methods based on the difference in charges, such as ion-exchange chromatography; methods mainly based on the difference in molecular weights, such as dialysis, ultrafiltration, gel filtration and SDS-polyacrylamide gel electrophoresis; methods based on specific affinity, such as affinity chromatography; methods based on the difference in hydrophobicity, such as reverse phase high performance liquid chromatography; and methods based on the difference in isoelectric points, such as isoelectric focusing. For example, a protein of the present invention can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxyapatite chromatography and lectin chromatography. Most preferably, high performance liquid chromatography is employed for purification. Well known techniques for refolding proteins may be employed to regenerate active conformation when the polypeptide is denatured during intracellular synthesis, isolation or purification.

The protein of the present invention can also be produced as a fusion protein with another protein. These fusion proteins are also included within the present invention. For the expression of such fusion proteins, any vectors can be used so long as the DNA encoding the protein can be inserted into the vectors and the vectors can express the fusion protein. Examples of proteins to which a polypeptide of the present invention can be fused include glutathione S-transferase (GST) and a hexa-histidine sequence (6×His). The fusion protein of the protein of the present invention with another protein can be advantageously purified by affinity chromatography using a substance with an affinity for the fusion partner protein. For example, fusion proteins with GST can be purified by affinity chromatography using glutathione as a ligand.

Where the protein of the present invention is a membrane protein, a cell transformed with DNA encoding the above protein of the present invention can express the protein on/in a membrane thereof. A membrane having the protein of the present invention being a membrane prepared from such a transformed cell, is within the scope of the present invention. It should be noted that herein, the term "membrane" encompasses a cell membrane, and all membranes of organelles. The preparation of membrane can be carried out by a method known in the art. For example, a membrane fraction can be obtained by culturing transformant cells, recovering cells from the culture product, suspending the cells in a suitable buffer solution, disrupting the cells using an homogenizer or by adding glass beads and disrupting in a vortex, removing undisrupted cells and the like by centrifugation, subjecting the supernatant to ultracentrifugation under suitable conditions, and suspending the obtained precipitate in a buffer solution. Conditions for ultracentrifugation can be determined as appropriate depending on the type of membrane etc.

The present invention also includes an inhibitory protein, i.e., a protein capable of inhibiting the activity of the protein of above item (1), (2) or (8). Examples of such inhibitory proteins include antibodies, or other proteins that bind to active sites of a protein of the above item (1), (2) or (8), thereby inhibiting the expression of their activity.

The present invention also relates to an antibody that specifically binds the protein of the present invention or a fragment thereof, and to production of such an antibody. The antibody is not specifically limited so long as it can recognize the protein of the present invention. Examples of such antibodies include polyclonal antibodies, monoclonal antibodies and their fragments, single chain antibodies and humanized antibodies. Antibody fragments can be produced by known techniques. Examples of such antibody fragments include, but not limited to, F(ab')2 fragments, Fab' fragments, Fab fragments and Fv fragments. The antibody that specifically binds the protein of the present invention can be produced using the protein of the present invention or a peptide thereof as an immunogen according to per se known process for producing antibodies or antisera. For example, a monoclonal or polyclonal antibody can be produced by administering the protein according to above item (1) or (2) as an antigen or epitope-bearing fragments to a non-human animal. Such methods are described, for example, in "Shin Idenshi Kougaku Handbook (New Genetic Engineering Handbook)", the third edition, an extra issue of "Jikken Igaku (Experimental Medicine)", YODOSHA CO., LTD.

In the case of polyclonal antibodies, for example, the protein of the present invention or a peptide thereof can be injected to animals such as rabbits to produce antibodies directed against the protein or peptide, and then their blood can be collected. The polyclonal antibodies can be purified from the blood, for example, by ammonium sulfate precipitation or ion-exchange chromatography, or by using the affinity column on which the protein has been immobilized.

In the case of monoclonal antibodies, for example, animals such as mice are immunized with the protein of the present invention, their spleen is removed and homogenized to obtain spleen cells, which are then fused with mouse myeloma cells by using a reagent such as polyethylene glycol. From the resulting hybrid cells (i.e. hybridoma cells), the clone producing the antibody directed against the protein of the present invention can be selected. Then, the resulting clonal hybridoma cells can be implanted intraperitoneally into mice, the ascitic fluid recovered from the mice. The resulting monoclonal antibody can be purified, for example, by ammonium sulfate precipitation or ion-exchange chromatography, or by using the affinity column on which the protein has been immobilized.

When the resulting antibody is used to administer it to humans, it is preferably used as a humanized antibody or human antibody in order to reduce its immunogenicity. The humanized antibody can be produced using transgenic mice or other mammals. For a general review of these humanized antibodies and human antibodies, see, for example, Morrison, S. L. et al., Proc. Natl. Acad. Sci. USA, 81:6851-6855 (1984); Jones, P. T. et al., Nature 321:522-525 (1986); Hiroshi Noguchi, Igaku no Ayumi (J. Clin. Exp. Med.) 167:457-462 (1993); Takashi Matsumoto, Kagaku to Seibutsu (Chemistry and Biology) 36:448-456 (1998). Humanized chimeric antibodies can be produced by linking a V region of a mouse antibody to a C region of a human antibody. Humanized antibodies can be produced by substituting a sequence derived from a human antibody for a region other than a complementarity-determining region from a mouse monoclonal antibody. In addition, human antibodies can be directly produced in the same manner as the production of conventional monoclonal antibodies by immunizing the mice whose immune systems have been replaced with human immune systems. These antibodies can be used to isolate or to identify clones expressing the protein or to purify the protein of the present invention from a cell extract or transformed cells producing the protein of the present invention. These proteins can also be used to construct ELISA, RIA (radioimmunoassay) and western blotting systems. These assay systems can be used for diagnostic purposes for detecting an amount of the protein of the present invention present in a body sample in a tissue or a fluid in the blood of an animal, preferably human. For example, they can be used for diagnosis of a disease characterized by undesirable activation of NF-κB resulting from (expression) abnormality of the protein of the present invention, such as inflammation, autoimmune disease, infection (for example, HIV infection), bone disease, cancer and the like. In order to provide a basis for diagnosis of a disease, a standard value must be established. However, this is a well-known technique to those skilled in the art. For example, a method of calculating the standard value comprises binding a body fluid or a cell extract of normal individual of a human or an animal to an antibody against the protein of the present invention under a suitable condition for the complex formation, detecting the amount of the antibody-protein complex by chemical or physical means and then calculating the standard value for the normal sample using a standard curve prepared from a standard solution containing a known amount of an antigen (the protein of the present invention). The presence of a disease can be confirmed by deviation from the standard value obtained by comparison of the standard value with the value obtained from a sample of an individual latently suffering from a disease associated with the protein of the present invention. These antibodies can also be used as reagents for studying functions of the protein of the present invention.

The antibody of the present invention can be used as a medicament as follows. Where the antibody of the present invention is used as a medicament, it is preferable to use an antibody which can inhibit the action of activating NF-κB possessed by the protein of the present invention (i.e. neutralizing antibody).

The antibodies of the present invention can be purified and then administered to patients of a disease characterized by undesirable activation of NF-κB resulting from (expression) abnormality of the protein of the present invention, such as inflammation, autoimmune disease, infection (such as HIV infection), bone disease, cancer and the like. Thus in another aspect, the present invention is a pharmaceutical composition which comprises the above antibody as an active ingredient, and therapy using the antibody of the present invention. In such pharmaceutical compositions, the active ingredient may be combined with other therapeutically active ingredients or inactive ingredients (e.g., conventional pharmaceutically acceptable carriers or diluents such as immunogenic adjuvants) and physiologically non-toxic stabilizers and excipients. The resulting combinations can be sterilized by filtration, and formulated into vials after lyophilization or into various dosage forms in stabilized and preservable aqueous preparations. Administration to a patient can be intra-arterial administration, intravenous administration and subcutaneous administration, which are well known to those skilled in the art. The dosage range depends upon the weight and age of the patient, route of administration and the like. Suitable dosages can be determined by those skilled in the art. These antibodies exhibit therapeutic activity by inhibiting the NF-κB activation mediated by the protein of the present invention.

The DNA of the present invention can also be used to isolate, identify and clone other proteins involved in intracellular signal transduction processes. For example, the DNA sequence encoding the protein of the present invention can be used as a "bait" in yeast two-hybrid systems (see e.g., Nature 340:245-246 (1989)) to isolate and clone the sequence encoding a protein ("prey") which can associate with the protein of the present invention. In a similar manner, it can be determined whether the protein of the present invention can associate with other cellular proteins (e.g., NIK and TRAF2). In another method, proteins which can associate with the protein of the present invention can be isolated from cell extracts by immunoprecipitation [see e.g., "Shin Idenshi Kougaku Handbook (New Genetic Engineering Handbook)", an extra issue of "Jikken Igaku (Experimental Medicine)", YODOSHA CO., LTD.] using antibodies directed against the protein of the present invention. In still another method, the protein of the present invention can be expressed as a fusion protein with another protein as described above, and immunoprecipitated with an antibody directed against the fusion protein in order to isolate a protein which can associate with the protein of the present invention.

The diagnostic assays offer a process for diagnosing diseases or determining a susceptibility to the diseases through detection of mutation in a gene for a protein according to item (1), (2) or (8) which has a function of activating NF-κB, by the methods described. In addition, such diseases may be diagnosed by methods comprising determining from a sample derived from a subject an abnormally decreased or increased level of protein or mRNA. Decreased or increased expression can be measured at the RNA level using any of the methods well known in the art for the quantitation of polynucleotides, for example, nucleic acid amplification methods such as RT-PCR, and methods such as RNase protection assay, Northern blotting and other hybridization methods. Assay techniques that can be used to determine levels of a protein in a sample derived from a host are well-known to those skilled in the art. Such assay methods include radioimmunoassays, competitive-binding assays, Western blot analysis and ELISA assays. The DNA of the present invention can be used to detect abnormality in the DNA or mRNA encoding the protein of the present invention or a peptide fragment thereof. The invention relates to a method for diagnosing a disease, or susceptibility to a disease associated with the expression of the protein according to above item (1), (2) or (8) in a subject, which comprises determining mutations in the polynucleotide sequence encoding the protein. Thus, for example, the DNA of the present invention is useful for gene diagnosis regarding damage, mutations, and reduced, increased or over-expression of the DNA or mRNA. That is, the present invention includes a method for diagnosing a disease or susceptibility to a disease associated with the expression or activity of NF-κB in a subject, which comprises the steps of:

(a) determining the presence or absence of a mutation in the nucleotide sequence encoding the protein according to any one of above item (1), (2) or (8), in the genome of the subject, and/or (b) analyzing the amount of expression of said protein in a sample derived from said subject, wherein a diagnosis of disease is preferably made when the amount of the protein expressed is 2-fold or higher than normal, or half or lower than normal.

When the nucleotide sequence encoding the protein of above item (1), (2) or (8) which has a function of activating NF-κB, contains a mutation according to the above step (a), the mutation may cause a disease associated with NF-κB activation. When the amount of the expression of the protein of above item (1), (2) or (8) is different from the normal value according to the above step (b), the abnormal expression of the novel protein of the present invention which acts to activate NF-κB may be responsible for diseases associated with NF-κB activation. In the above step (a), determination of the presence or absence of a mutation in the nucleotide sequence of a the gene encoding the protein of above item (1), (2) or (8) which has a function of activating NF-κB, may involve RT-PCR using a part of the nucleotide sequences of genes encoding these proteins as a primer, followed by conventional DNA sequencing to detect the presence or absence of the mutation. PCR-SSCP [Genomics 5:874-879 (1989); "Shin Idenshi Kougaku Handbook (New Genetic Engineering Handbook)", an extra issue of "Jikken Igaku (Experimental Medicine)", YODOSHA CO., LTD.] can also be used to determine the presence or absence of the mutation.

Measurement of the amount of the expression of the protein in the above step (b) may involve, for example, using the antibody of above item (18) or (19).

The present invention also relates to a method for screening compounds which inhibit or promote NF-κB activation using the proteins of the invention, which comprises the steps of:

(a) providing a cell with a gene encoding a protein that activates NF-κB, and a component that provides a detectable signal upon activation of NF-κB;

(b) culturing the transformed cell under conditions, which permit the expression of the gene in the transformed cell;

(c) contacting the transformed cell with one or more compounds; and (d) measuring the detectable signal; and (e) isolating or identifying an activator compound and/or an inhibitor compound by measuring the detectable signal.

Further, it is preferable to isolate or identify as an activator compound, a compound that increases said detectable signal 2-fold or higher than normal, and to isolate or identify as an inhibitor compound, a compound that decreases said detectable signal half or less than normal.

Examples of components capable of providing a detectable signal include reporter genes. Reporter genes are used instead of directly detecting the activation of transcription factors of interest. The transcriptional activity of a promoter of a gene is analyzed by linking the promoter to a reporter gene and measuring the activity of the product of the reporter gene ("Bio Manual Series 4" (1994), YODOSHA CO., LTD.).

Any peptide or protein can be used so long as those skilled in the art can measure the activity or amount of the expression product (including the amount of the produced mRNA) of the reporter genes. For example, enzymatic activity of chloramphenicol acetyltransferase, β-galactosidase, luciferase, etc., can be measured. Any reporter plasmids can be used to evaluate NF-κB activation so long as the reporter plasmids have an NF-κB recognition sequence inserted upstream of the reporter gene. For example, pNF-κB-Luc (STRATAGEGE) can be used. Other examples include NF-κB dependent reporter plasmids described in Tanaka S. et al., J. Vet. Med. Sci. Vol. 59 (7); Rothe M. et al., Science Vol. 269, p. 1424-1427 (1995).

Any host cells may be used so long as NF-κB activation can be detected in the host cells. Preferred host cells are mammalian cells such as 293-EBNA cells. Transformation and culture of the cells can be carried out as described above.

In a specific embodiment, the method for screening a compound which inhibits or promotes NF-κB activation comprises culturing the transformed cell for a certain period of time, adding a certain amount of a test compound, measuring the reporter activity expressed by the cell after a certain period of time, and comparing the activity with that of a cell to which the test compound has not been added. The reporter activity can be measured by methods known in the art (see e.g., "Bio Manual Series 4" (1994), YODOSHA CO., LTD.). Examples of test compounds include, but not limited to, low molecular weight compounds and peptides. Test compounds may be artificially synthesized compounds or naturally occurring compounds. Test compounds may be a single compound or mixtures. Examples of such detectable signals which may be measured include the amount of mRNA or proteins for genes whose expression is known to be induced by NF-κB activation (e.g., genes for IL-1 and TNF-α) in addition to the above reporter genes. The amount of mRNA can be measured, for example, by northern hybridization, RT-PCR, etc. The amount of proteins can be measured, for example, by using antibodies. The antibodies may be produced by known methods. Commercially available antibodies (from, e.g., Wako Pure Chemical Industries, Ltd.) can also be used.

It is also possible to produce a pharmaceutical composition according to the following steps (a) to (f):

(a) providing a cell with a gene encoding a protein that activates NF-κB, and a component that provides a detectable signal upon activation of NF-κB;

(b) culturing the transformed cell under conditions, which permit the expression of the gene in the transformed cell;

(c) contacting the transformed cell with one or more candidate compounds;

(d) measuring the detectable signal;

(e) isolating or identifying an activator compound and/or an inhibitor compound by measuring the detectable signal; and (f) optimizing the isolated or identified compound as a pharmaceutical composition.

Further, it is preferable to isolate or identify as an activator compound, a compound that increases said detectable signal 2-fold or higher than normal, and to isolate or identify as an inhibitor compound, a compound that decreases said detectable signal half or less than normal.

The protein of the present invention may also be used in a method for the structure-based design of an agonist, antagonist or inhibitor of the protein, by:

(a) determining in the first instance the three-dimensional structure of the protein;

(b) deducing the three-dimensional structure for the likely reactive or binding site(s) of an agonist, antagonist or inhibitor;

(c) synthesising candidate compounds that are predicted to bind to or react with the deduced binding or reactive site; and (d) testing whether the candidate compounds are indeed agonists, antagonists or inhibitor.

The present invention also includes a compound obtainable by the above screening method. However, the screening method of the present invention is not limited to the above method. The present invention also includes a process for producing the pharmaceutical composition by the method of above item (16).

There is no special limitation to the above candidate compounds. Such compounds include low molecular weight compounds and peptides. They may be artificially synthesised compounds and naturally occurring compounds. As the compounds obtained by the above screening methods have a function of inhibiting or promoting NF-κB activation, they are useful as therapeutic or preventive pharmaceuticals for the treatment of diseases resulting from unfavorable activation or inactivation of NF-κB. In order to isolate and purify the target compounds from the mixture, it is suitable to combine the known methods such as filtration, extraction, washings, drying, concentration, crystallization, various chromatography. When obtainment of a salt of the compounds is desired, a compound which is obtained in the form of a salt can be purified as it is. A compound which is obtained in the free form can be converted into a salt by isolating and purifying a salt obtained by dispersing or dissolving the compound into a suitable solvent and then adding a desired acid or base. Examples of a step to optimize the compounds or salts thereof obtained by the method of the present invention as a pharmaceutical composition, include methods of formulating according to ordinary processes such as the following. The above compounds or their pharmaceutically acceptable salts in an amount effective as an active ingredient, and pharmaceutically acceptable carriers can be mixed. A form of formulation suitable for the mode of administration is selected. A composition suitable for oral administration includes a solid form such as tablet, granule, capsule, pill and powder, and solution form such as solution, syrup, elixir and dispersion. A form useful for parenteral administration includes sterile solution, dispersion, emulsion and suspension. The above carriers include, for example, sugars such as gelatin, lactose and glucose, starches such as corn, wheat, rice and maize, fatty acids such as stearic acid, salts of fatty acids such as calcium stearate, magnesium stearate, talc, vegetable oil, alcohol such as stearyl alcohol and benzyl alcohol, gum, and polyalkylene glycol. Examples of such liquid carriers include generally water, saline, sugar solution of dextrose and the lile, glycols such as ethylene glycol, propylene glycol and polyethylene glycol.

The present invention also includes a kit for screening compounds for activity to inhibit or promote NF-κB activation. The kit comprises reagents and the like necessary for screening compounds for inhibiting or promoting activity for NF-κB activation, including:

(a) a cell comprising a gene encoding a protein that activates NF-κB, and a component test provides a detectable signal enabling detection of NF-κB activation after activation of NF-κB; and (b) reagents for measuring the detectable signal.

In another aspect, the present invention relates to a diagnostic kit which comprises:

(a) a polynucleotide of the present invention having a nucleotide sequence expressed by SEQ ID NO: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 or 179;

(b) a nucleotide sequence complementary to that of (a);

(c) a protein of the present invention having an amino acid sequence expressed by SEQ ID NO: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 or 180, or a fragment thereof; or (d) an antibody to the protein of the present invention of (c).

A kit comprising at least one of (a) to (d) is useful for diagnosing a disease or susceptibility to a disease such as inflammation, autoimmune diseases, infectious diseases (e.g., HIV infection) and cancers.

Because NF-κB is involved in a wide variety of pathological conditions such as inflammation, autoimmune diseases, cancers and viral infections, it is an attractive target for drug design and therapeutic intervention. Many experiments show that NF-κB activity may have significant physiological effects [see e.g., Ann. Rheum. Ds. 57:738-741 (1998); American Journal of Pathology 152:793-803 (1998); ARTHRITIS & RHEUMATISM 40:226-236 (1997); Am. J. Respir. Crit. Care Med. 158:1585-1592 (1998); J. Exp. Med. 188:1739-1750 (1998); Gut 42:477-484 (1998); The Journal of Immunology 161:4572-4582 (1998); Nature Medicine 3:894-899 (1997)]. The finding of the new protein described herein capable of activating NF-κB has provided a new method for controlling an abnormal NF-κB function. Thus, the present invention also relates to use of a compound which inhibits the function of the protein capable of activating NF-κB described above, for inhibiting NF-κB activation. Further, the present invention relates to a method of using a compound which activates the function of the protein capable of activating NF-κB described above, for promoting NF-κB activation. The compound obtained by the above screening method, which inhibits NF-κB activation, is useful as a medicament to treat or prevent diseases characterized by undesirable activation of NF-κB, such as inflammation, autoimmune diseases (such as rheumatoid arthritis, systemic lupus erythematosus, asthma, etc), infectious diseases, bone diseases, and graft rejection. Recently, it has also become apparent that NF-κB activation controls apoptosis of cells. The compound obtained by the above screening method, which inhibits NF-κB activation, may be capable of stimulating apoptosis. Diseases which may be treated by the induction of apoptosis include tumors.

Further, examples of diseases related to abnormality in NF-κB activation include AIDS (acquired immunodeficiency syndrome), neurodegenerative diseases (Alzheimer's disease, Parkinson's disease, amyotrophic lateral sclerosis, etc.) ischemic disorders (i.e. those caused by cardiac infarction, reperfusion injury, etc), myelogenesis incompetency syndrome (aplastic anemia, etc), skin diseases (Toxic epidermal necrolysis, etc), proliferative nephritis (IgA nephritis, purpuric nephritis, lupus nephritis, etc) and fulminant hepatitis. Thus, a compound obtained by the above screening method, which inhibits or promotes NF-κB activation, is useful as a medicament to treat or prevent these diseases.

In addition, the gene encoding the protein of the present invention is useful for gene therapy to treat various diseases such as cancers, autoimmune diseases, allergy diseases and inflammatory response. "Gene therapy" refers to administering into the human body a gene or a cell into which a gene has been introduced. The protein of the present invention and the DNA encoding the protein can also be used for diagnostic purposes. That is, according to the present invention, there is provided a gene therapy agent comprising a gene encoding the protein of the present invention.

Further, where a gene encoding the protein of the present invention is used for gene therapy, the RNA interference (RNAi) method, which is described later, can be applied. That is, according to the present invention, there is also provided a vector for gene therapy that can express a double stranded nucleic acid having a nucleotide sequence encoding the protein of the present invention. Further, the present invention encompasses a gene therapy agent comprising one or more double stranded nucleic acids having a nucleotide sequence encoding the protein of the present invention, and/or one or more vectors for gene therapy use which express a double stranded nucleic acid having a nucleotide sequence encoding the protein of the present invention.

Forms of the agent for gene therapy, are not particularly limited, and examples include a pharmaceutical composition wherein an expression vector including the gene of the present invention is contained in a pharmaceutical carrier consisting of physiological buffer solution. A pharmaceutical carrier can otherwise include a suitable stabilizing agent (e.g. nuclease inhibitor, etc.), chelating agent (e.g. EDTA, etc.) and/or other excipients. Further, the agent for gene therapy can be supplied as a complex of the double stranded nucleic acid of the present invention and/or the expression vector of the present invention with a liposome. The gene therapy agent can be administered, for example, by using a catheter. The gene therapy agent of the present invention can also, for example, be directly injected into a patient's blood vessel.

The dose of the gene therapy agent of the present invention to be administered should be increased or decreased as appropriate depending on conditions such as the age, sex, weight, and condition of the patient, and administration route, etc, however, generally, the dose for a single administration to an adult is within a range of about 1 μg/kg to 1000 mg/kg, and preferably within a range of 10 μg/kg to 100 mg/kg, as an amount of DNA, being the effective component. There is no limitation on number of administrations. The present invention also encompasses a method where one or more the double stranded nucleic acids of the present invention and/or one or more the expression vectors of the present invention, are selected and administered simultaneously or sequentially.

The compound obtained by the screening method of the present invention or a salt thereof can be formulated into the above pharmaceutical compositions (e.g., tablets, capsules, elixirs, microcapsules, sterile solutions and suspensions) according to conventional procedures. The formulations thus obtained are safe and of low toxicity, and can be administered, for example, to humans and mammals (e.g., rats, rabbits, sheep, pigs, cattle, cats, dogs and monkeys). Administration to patients can be carried out by methods known in the art, such as intra-arterial injection, intravenous injection and subcutaneous injection. The dosage may vary with the weight and age of the patient as well as a mode of administration, but those skilled in the art can appropriately select suitable dosages. When the compound can be encoded by DNA, the DNA can be inserted into a vector for gene therapy, and gene therapy can be carried out. The dosage and mode of administration may vary with the weight, age and symptoms of the patient, but those skilled in the art can appropriately select them. Thus, the present invention also relates to a pharmaceutical composition which comprises the above compound as an active ingredient.

In addition, the above compound is useful as a medicament to treat or prevent diseases characterized by abnormal NF-κB activity, such as inflammation, autoimmune diseases, viral diseases, infectious diseases, cancers and bone diseases. Thus, the present invention also relates to a pharmaceutical composition for inflammation, autoimmune diseases, viral diseases, infectious diseases, cancers, bone diseases, etc., which comprises the above compound. Specifically, the compound is useful as a therapeutic and/or prophylactic drug against, for example, rheumatoid arthritis, osteoarthritis, systemic lupus erythematosus, diabetes, sepsis, asthma, allergic rhinitis, ischemic heart diseases, inflammatory intestinal diseases, subarachnoid hemorrhage, viral hepatitis, AIDS, atherosclerosis, atopic dermatosis, viral infections, Crohn's disease, diabetes, gout, hepatitis, multiple sclerosis, cardiac infarction, nephritis, osteoporosis, Alzheimer's, Parkinson's disease, Huntington's chorea, psoriasis, amyotrophic lateral sclerosis, or aplastic anemia.

The present invention also relates to the use of a pharmaceutical composition produced according to above item (16) for manufacturing a medicament against inflammation, autoimmune diseases, viral diseases, cancers, infectious diseases, bone diseases, etc. The present invention also includes an antisense oligonucleotide against a gene of any one of above items (3) to (7). An antisense oligonucleotide refers to an oligonucleotide complementary to the target gene sequence. The antisense oligonucleotide can inhibit the expression of the target gene by inhibiting RNA functions such as translation to proteins, transport to the cytoplasm and other activity necessary for overall biological functions. In this case, the antisense oligonucleotide may be RNA or DNA. The DNA sequence of the present invention can be used to produce an antisense oligonucleotide capable of hybridizing with the mRNA transcribed from the gene encoding the protein of the present invention. It is known that an antisense oligonucleotide generally has an inhibitory effect on the expression of the corresponding gene (see e.g., Saibou Kougaku Vol. 13, No. 4 (1994)). The oligonucleotide containing an antisense coding sequence against a gene encoding the protein of the present invention can be introduced into a cell by standard methods. The oligonucleotide effectively blocks the translation of mRNA of the gene encoding the protein of the present invention, thereby blocking its expression and inhibiting undesirable activity.

The antisense oligonucleotide of the present invention may be a naturally occurring oligonucleotide or its modified form [see e.g., Murakami & Makino, Saibou Kougaku Vol. 13, No. 4, p. 259-266 (1994); Akira Murakami, Tanpakushitsu Kakusan Kouso (PROTEIN, NUCLEIC ACID AND ENZYME) Vol. 40, No. 10, p. 1364-1370 (1995), Tunenari Takeuchi et al., Jikken Igaku (Experimental Medicien) Vol. 14, No. 4 p 85-95(1996)]. Thus, the oligonucleotide may have modified sugar moieties or inter-sugar moieties. Examples of such modified forms include phosphothioates and other sulfur-containing species used in the art. According to several preferred embodiments of the present invention, at least one phosphodiester bond in the oligonucleotide is substituted with the structure which can enhance the ability of the composition to permeate cellular regions where RNA with the activity to be regulated is located.

Such substitution preferably involves a phosphorothioate bond, a phosphoramidate bond, methylphosphonate bond, or a short-chain alkyl or cycloalkyl structure. The antisense oligonucleotide may also contain at least some modified base forms. Thus, it may contain purine and pyrimidine derivatives other than naturally occurring purine and pyrimidine. Similarly, the furanosyl moieties of the nucleotide subunits can be modified so long as the essential purpose of the present invention is attained. Examples of such modifications include 2'-O-alkyl and 2'-halogen substituted nucleotides. Examples of modifications in sugar moieties at their 2-position include OH, SH, SCH3, OCH3, OCN or O(CH2)nCH3, wherein n is 1 to about 10, and other substituents having similar properties. All the analogues are included in the scope of the present invention so long as they can hybridize with the mRNA of the gene of the present invention to inhibit functions of the mRNA.

The antisense oligonucleotide of the present invention contains about 3 to about 50 nucleotides, preferably about 8 to about 30 nucleotides, more preferably about 12 to about 25 nucleotides. The antisense oligonucleotide of the present invention can be produced by the well-known solid phase synthesis technique. Devices for such synthesis are commercially available from some manufactures including Applied Biosystems. Other oligonucleotides such as phosphothioates can also be produced by methods known in the art.

The antisense oligonucleotide of the present invention is designed to hybridize with the mRNA transcribed from the gene of the present invention. Those skilled in the art can easily design an antisense oligonucleotides based on a given gene sequence (For example, Murakami and Makino: Saibou Kougaku Vol. 13 No. 4 p 259-266 (1994), Akira Murakami: Tanpakushitsu Kakusan Kouso (PROTEIN, NUCLEIC ACID AND ENZYME) Vol. 40 No. 10 p 1364-1370 (1995), Tunenari Takeuchi et al., Jikken Igaku (Experimental Medicine) Vol. 14 No. 4 p 85-95 (1996)). Recent study suggests that antisense oligonucleotides which are designed in a region containing 5' region of mRNA, preferably, the translation initiation site, are most effective for the inhibition of the expression of a gene. The length of the antisense oligonucleotides is preferably 15 to 30 nucleotides and more preferably 20 to 25 nucleotides. It is important to confirm no interaction with other mRNA and no formation of secondary structure in the oligonucleotide sequence by homology search. The evaluation of whether the designed antisense oligonucleotide is functional or not can be determined by introducing the antisense oligonucleotide into a suitable cell and measuring the amount of the target mRNA, for example by northern blotting or RT-PCR, or the amount of the target protein, for example by western blotting or fluorescent antibody technique, to confirm the effect of expression inhibition.

Another method includes the triple helix technique. This technique involves forming a triple helix on the targeted intranuclear DNA sequence, thereby regulating its gene expression, mainly at the transcription stage. The antisense oligonucleotide is designed mainly in the gene region involved in the transcription and inhibits the transcription and the production of the protein of the present invention. Such RNA, DNA and oligonucleotide can be produced using known synthesizers.

The antisense oligonucleotide may be introduced into the cells containing the target nucleic acid sequence by any of DNA transfection methods such as calcium phosphate method, electroporation, lipofection, microinjection, or gene transfer methods including the use of gene transfer vectors such as viruses. An antisense oligonucleotide expression vector can be prepared using a suitable retrovirus vector, then the expression vector can be introduced into the cells containing the target nucleic acid sequence by contacting the vector with the cells in vivo or ex vivo.

The DNA of the present invention can be used in the antisense RNA/DNA technique or the triple helix technique to inhibit NF-κB activation mediated by the protein of the present invention.

Further, polypeptides encoded by the polynucleotides of SEQ ID NOS: 6, 88, 153 and 161 are explained below in detail, as examples. However, these do not limit the present invention in any way.

As a result of preparing an expression vector for a fusion protein with GFP and expressing in Vero cells or COS 7 cells, the polypeptide encoded by the polynucleotide of SEQ ID NO: 6, was found to be primarily localized in endoplasmic reticulum. Further, as a result of examination of expression in human tissues (bone marrow, brain, colon, heart, kidney, leukocyte (granule), leukocyte (resting lymph node), thymus, spleen, small intestine, trachea, liver, lung, skin, adrenal gland, salivary gland, testis and uterus) by Real-time PCR, high expression of the polypeptide was primarily observed in leukocyte (granule), spleen, lung and uterus.

Therefore, the polynucleotide of SEQ ID NO: 6 and the polypeptide encoded by the polynucleotide are useful as reagents for identification of tissues or cell types present in a biological sample, and for diagnosis of a disease or condition including (but not limited to) disorders of leukocyte, spleen, lung and uterus.

Further, the tissue distribution thereof indicates that the polynucleotide and polypeptide of the present invention are useful in the diagnosis and treatment of various immune system disorders (for example, infection, inflammation, allergy, immune deficiency and the like), and lung-related disorders (for example, lung cancer, infection, asthma, and the like).

The polypeptide encoded by the polynucleotide of SEQ ID NO: 88 possesses a sequence having homology to TIR (Toll/IL-1 receptor) domain sequence, and interacts with at least Toll-like receptor (TLR) 3, TLR4 and TLR9. Further, as a result of preparing an expression vector for a fusion protein with GFP, and expressing in Vero cells or COS 7 cells, the polypeptide was primarily localized in cell membrane. Further, as a result of examination of expression in human tissues (bone marrow, brain, colon, heart, kidney, leukocyte (granule), leukocyte (resting lymph node), thymus, spleen, small intestine, trachea, liver, lung, skin, adrenal gland, salivary gland, testis and uterus) using Real-time PCR, high expression of the polypeptide was primarily observed in leukocyte (granule), spleen, lung and uterus.

Therefore, the polynucleotide of SEQ ID NO: 88 and the polypeptide encoded by the polynucleotide are useful as reagents for identification of tissues or cell types present in a biological sample, and for diagnosis of a disease or condition including (but not limited to) disorders of leukocyte, spleen, lung and uterus.

Further, the tissue distribution thereof indicates that the polynucleotide of SEQ ID NO: 88 and the polypeptide are useful in the diagnosis and treatment of various immune system disorders (for example, infection, inflammation, allergy, immune deficiency and the like), and lung-related disorders (for example, lung cancer, infection, asthma, and the like).

Further, the fact that the polypeptide of the present invention interacts with TLR, together with intracellular localization results, indicate that the polypeptide is deeply involved in immune system, particularly signal transduction in innate immune system, and that the polynucleotide and polypeptide of the present invention are useful for diagnosis and treatment of various immune system disorders. In particular, they are useful in the diagnosis and treatment of immune system disorders related to chronic or acute microorganism infections (e.g. bacterial, fungal or viral infection).

As a result of examination of expression in human tissues (bone marrow, brain, colon, heart, kidney, leukocyte (granule), leukocyte (resting lymph node), thymus, spleen, small intestine, trachea, liver, lung, skin, adrenal gland, salivary gland, testis and uterus) using Real-time PCR, high expression of the polypeptide encoded by the polynucleotide of SEQ ID NO: 153 was primarily observed in lung and spleen. Further, the polypeptide encoded by the polynucleotide of SEQ ID NO: 153 possesses a sequence having homology to TIR (Toll/IL-1 receptor) domain sequence, and as a result of cotransfecting EBNA cells with a vector for expression of the polypeptide of SEQ ID NO: 153 and a reporter plasmid for human interferon (IFN)-β gene promoter, induction of expression of IFNβ promoter reporter was observed. The induction of IFNβ expression can be measured by a method using a reporter plasmid or a method comprising the measurement of the amount of mRNA or protein of IFNβ. The amount of mRNA can be measured by, for example, Northern hybridization or RT-PCR. The amount of protein can be measured by, for example, a method using an antibody or ELISA. Antibodies can be prepared by a method known in the art, or obtained from manufacturer (for example, FUNAKOSHI or BioSource International).

Therefore, the polynucleotide of SEQ ID NO: 153 and the polypeptide encoded by the polynucleotide are useful as reagents for identification of tissues or cell types present in a biological sample, and for diagnosis of a disease or condition including (but not limited to) disorders of lung and spleen.

Further, the tissue distribution thereof indicates that the polynucleotide and polypeptide of the present invention are useful in the diagnosis and treatment of various immune system disorders (for example, infection, inflammation, allergy, immune deficiency and the like), and lung-related disorders (for example, lung cancer, infection, asthma, and the like).

Further, the fact that the polypeptide of the present invention possesses a TIR domain sequence and is a polypeptide involved in expression induction of IFN-β indicates that the polypeptide of the present invention is involved in signal transduction in the innate immune system, and that the polynucleotide and polypeptide of the present invention are useful for diagnosis and treatment of various immune system disorders. In particular, it is possible that they are useful for the diagnosis and treatment of disorders of the immune system related to chronic or acute microorganism infections (for example, bacterial, fungal or viral infection).

It should be noted that the reporter plasmid for human IFN-β gene promoter was prepared in the following method. Primers of two synthetic oligonucleotides:

```
5'-CTAGCTAGCTAGAAACTACTAAAATGTAAATGACATAG -3'    (SEQ ID NO: 183)
and
5'-CGCAAGCTTGAAAGGTTGCAGTTAGAATGTCCTTTC -3',    (SEQ ID NO: 184)
``` were designed, and using this primer pair, PCR was performed using human genome (CLONTECH) as a template. An amplified fragment of approx. 0.15 kb was isolated, and after digesting with NheI and HindIII restriction enzymes, and the fragment was inserted between the NheI site and HindIII site of firefly luciferase reporter vector pGL3-Basic Vector (Promega Corporation) using T4 DNA ligase to prepare the plasmid.

As a result of examining expression of the gene of SEQ ID NO: 161 in human tissues (bone marrow, brain, colon, heart, kidney, leukocyte (granule), leukocyte (resting lymph node), thymus, spleen, small intestine, trachea, liver, lung, skin, adrenal gland, salivary gland, testis, uterus) by RT-PCR, high expression was observed primarily in lung.

Therefore, the polynucleotide of SEQ ID NO: 161 and the polypeptide encoded by the polynucleotide are useful as reagents for identification of tissues or cell types present in a biological sample, and for diagnosis of a disease or condition including (but not limited to) disorders of the lung.

Further, the tissue distribution thereof indicates that the polynucleotide and polypeptide of the present invention are useful in the diagnosis and treatment of lung-related disorders (for example, lung cancer, infection due to bacteria and virus, asthma, and the like).

The antisense oligonucleotide against the gene encoding the protein of the present invention is useful as a medicament to treat or prevent diseases characterized by undesirable activation of NF-κB, such as inflammation, autoimmune diseases, infectious diseases (e.g., HIV infection) and cancers. Thus, the present invention also includes a pharmaceutical composition which comprises the above antisense oligonucleotide as an active ingredient. The antisense oligonucleotide can also be used to detect such diseases using northern hybridization or PCR.

The present invention also includes a ribozyme or a deoxyribozyme which inhibits NF-κB activation. A ribozyme or a deoxyribozyme is an RNA capable of recognizing a nucleotide sequence of a nucleic acid and cleaving the nucleic acid (see e.g., Hiroshi Yanagawa, "Jikken Igaku (Experimental Medicine) Bioscience 12: New Age of RNA). The ribozyme or the deoxyribozyme can be produced so that it cleaves the selected target RNA (e.g., mRNA encoding the protein of the present invention). Based on the nucleotide sequence of the DNA encoding the protein of the present invention, the ribozyme or the deoxyribozyme specifically cleaving the mRNA of the protein of the present invention can be designed. Such ribozyme or deoxyribozyme has a complementary sequence to the mRNA for the protein of the present invention, complementarily associates with the mRNA and then cleaves the mRNA, which results in reduction or entire loss of the expression of the protein of the present invention. The level of the reduction of the expression is dependent on the level of the ribozyme or the deoxyribozyme expression in the target cells.

There are two types of ribozyme or deoxyribozyme commonly used: a hammerhead ribozyme or deoxyribozyme and a hairpin ribozyme or deoxyribozyme. In particular, hammerhead ribozymes or deoxyribozymes have been well studied regarding their primary and secondary structure necessary for their cleavage activity, and those skilled in the art can easily design the ribozymes or the deoxyribozymes nucleotided solely on the nucleotide sequence information for the DNA encoding the protein of the present invention [see e.g., Iida et al., Saibou Kougaku Vol. 16, No. 3, p. 438-445 (1997); Ohkawa & Taira, Jikken Igaku (Experimental Medicine) Vol. 12, No. 12, p. 83-88 (1994)]. It is known that the hammerhead ribozymes or deoxyribozymes have a structure consisting of two recognition sites (recognition site I and recognition site II forming a chain complementary to target RNA) and an active site, and cleave the target RNA at the 3' end of its sequence NUX (wherein N is A or G or C or U, and X is A or C or U) after the formation of a complementary pair with the target RNA in the recognition sites. In particular, the sequence GUC (or GUA) has been found to have the highest activity [see e.g., Koizumi, M. et al., Nucl. Acids Res. 17:7059-7071 (1989); Iida et al., Saibou Kougaku Vol. 16, No. 3, p. 438-445 (1997); Ohkawa & Taira, Jikken Igaku (Experimental Medicine) Vol. 12, No. 12, p. 83-88 (1994); Kawasaki & Taira, Jikken Igaku (Experimental Medicine) Vol. 18, No. 3, p. 381-386 (2000)].

Therefore the sequence GTC (or GTA) is searched out, and a ribozyme is designed to form several, up to 10 to 20 complementary base pairs around that sequence. The suitability of the designed ribozyme or the designed deoxyribozyme can be evaluated by checking whether the prepared ribozyme or the prepared deoxyribozyme can cleave the target mRNA in vitro according to the method described for example in Ohkawa & Taira, Jikken Igaku (Experimental Medicine) Vol. 12, No. 12, p. 83-88 (1994). The ribozyme or the deoxyribozyme can be prepared by methods known in the art to synthesize RNA molecules.

Alternatively, the sequence of the ribozyme or the deoxyribozyme can be synthesized on a DNA synthesizer and inserted into various vectors containing a suitable RNA polymerase promoter (e.g., T7 or SP6) to enzymatically synthesize an RNA molecule in vitro. Such ribozymes or deoxyribozymes can be introduced into cells by gene transfer methods such as microinjection. Another method involves inserting a DNA encoding ribozyme into a suitable expression vector and introducing the vector into cell strains, cells or tissues. Suitable vectors can be used to introduce the ribozyme or the deoxyribozyme into a selected cell. Examples of vectors commonly used for such purpose include plasmid vectors and animal virus vectors (e.g., retrovirus, adenovirus, herpes or vaccinia virus vectors). Such ribozymes or deoxyribozymes are capable of inhibiting the NF-κB activation mediated by the protein of the present invention.

According to the present invention, there is provided a double stranded nucleic acid which inhibits an action of activating NF-κB. That is, there is provided a double stranded nucleic acid which possesses a sequence corresponding to part of the nucleotide sequences described in (3) to (7) above. The term "a sequence corresponding to part of the nucleotide sequences" herein means that the sequence is substantially identical to the part of the nucleotide sequences. That is, one strand of a double strand nucleic acid comprises a substantially identical sequence with a part of the nucleotide sequences of interest, and the other strand of the double strand nucleic acid comprises a sequence complementary to the above strand. The term "substantially identical" means that the sequence is completely identical or identical to a extent such that the double strand nucleic acid has an inhibitory action described below.

It has recently been clarified that when double stranded RNA (dsRNA) is introduced into a cell, a phenomenon occurs, which is known as RNA interference (RNAi) wherein gene expression is inhibited as a result of specific degradation of mRNA corresponding to that sequence (e.g. Fire A et al., Nature 391: p 806-811 (1998), Elbashir S. M. et al., Genes Dev. 15: p 188-200 (2001)). dsRNA introduced into a cell is fragmentized into short interfering RNAs (siRNA) of 21-25 base pairs, due to an RNase specific for double stranded RNA, known as a Dicer, which belongs the RNase III family. This siRNA binds specifically with a protein, to form a complex called as a RISC (RNA-induced silencing complex). This complex recognizes and binds with mRNA having the same sequence as the siRNA, cleaves target mRNA by a RNaseIII-like enzyme activity at the center portion of siRNA, and as a result, gene expression is inhibited. (Sharp P. A. Genes Dev. 15: p 485-490 (2001)).

The nucleotide sequence of the present invention can be used for preparation of a double stranded nucleic acid which inhibits production of the polypeptide of the present invention due to an RNA interference effect against mRNA transcribed from the polynucleotide of the present invention. That is, the double stranded nucleic acid of the present invention is designed using the nucleotide sequence of the polynucleotide of the present invention. When the double stranded nucleic acid of the present invention is designed by the method described below, with reference to, for example, the reports of Kazunori Taira, et al.: RNAi Jikken Protocol, Yodosha (2003), and Elbashir S. M. et al.: Genes Dev. 15: p 188-200 (2001), it can be obtained with higher probability compared to where it is designed randomly: A region downstream of an initiation codon is selected, and from the selected region, a region consisting AA(N19-29)TT or AA(N21-31) is searched for, and the GC content of this sequence is calculated. A GC content of 50% is ideal; however, a sequence having a GC content of from at least 30% to 70% is selected. The sequence selected using the above criteria is checked to determine if it is specific for the target gene by a BLAST (e.g. EST database of NCBI) search. A double stranded nucleic acid designed in this manner does not necessarily possess the desired RNA interference effect. Evaluation of whether or not interference effect is exhibited can be performed by a method of confirming expression inhibition effect wherein, using a suitable cell, a double stranded nucleic acid is introduced or a double stranded nucleic acid is expressed within the cell, and an amount of subject mRNA is measured (e.g. Northern blot or RT-PCR methods) or an amount of subject protein is measured (e.g. Western blot or fluorescent antibody method) or activity of the subject protein is measured, by methods known to persons skilled in the art.

The double stranded nucleic acid of the present invention consists of an antisense strand and a sense strand thereof. The antisense strand comprises an antisense sequence of 18 to 29, preferably 19 to 25 nucleotides, completely complementary to a partial sequence of the oligonucleotide of the present invention, and further, comprises 1 to 4 bases at the 3'-end which protrude when annealed with the sense strand (overhang). The sense strand ordinarily comprises a completely complementary sequence to the antisense strand, and further, comprises 1 to 4 bases protruding at the 3' end (overhang). To the extent that the antisense strand and the sense strand form a double strand, one or more mutations may be present in the sense strand. The nucleic acid of the sense strand and the antisense strand may be RNA, DNA, or a mixture thereof. However, it is preferable that the antisense sequence is RNA. Further, it is extremely preferable that both the sense strand and the antisense strand are RNA. The overhang portion may be formed with deoxyribonucleotides G, A, T, and C and/or ribonucleotides G, A, U, and C, but a deoxyribonucleotide T and a ribonucleotide U are preferable. The number of overhang nucleotides is preferably 2 or 3, and 2, is extremely preferable. Suitable examples include UU (RNA) and TT (DNA).

Methods for preparing the double stranded nucleic acid of the present invention include chemical synthesis, methods of in vitro synthesis and methods of effecting expression within a cell using an expression vector (e.g. Takashi Morita, et al: Tanpakushitu Kakusan Kouso (Proteins, Nucleic Acids and Enzymes) Vol. 47 No. 14 p 1939-1945 (2002); Asako Sugimoto, Kagaku to Seibutsu (Chemistry and Biology) Vol. 40 No. 11: p 713-718 (2002); Makoto Miyagishi, et al.: Jikken Igaku (Experimental Medicine) Vol. 20 No. 18 p 2667-2672 (2002); Kazunori Taira, et al.: RNAi Jikken Protocol, Yodosha (2003)).

A chemical synthesis method is a method where double stranded nucleic acid is prepared by annealing an artificially synthesized sense strand and antisense strand. The thus prepared double stranded nucleic acid can be introduced into a cell using a reagent such as FuGENE6 (Roche) or Lipofectamine 2000 (Invitrogen).

A method of in vitro synthesis is a method of preparing a double stranded nucleic acid (siRNA) wherein, for example, using T7 promoter and T7 RNA polymerase, a synthetic oligonucleotide having a 19-29 base sequence of the target gene is ligated downstream of the binding site of T7 RNA polymerase, sense RNA and antisense RNA are synthesized by in vitro transcription, and they are annealed in vitro. The prepared siRNA can be introduced into a cell by lipofection methods using FuGENE6 (Roche).

A method for effecting intracellular expression using an expression vector is a method of effecting intracellular production of a double stranded nucleic acid (siRNA) using an siRNA expression vector. Methods of intracellular synthesis of siRNA include, in addition to the method described in the Examples, wherein a sense strand and an antisense strand are simultaneously expressed from both ends by two kinds of promoters, a method of, for example, effecting expression of a sense strand and an antisense strand from separate transcription units, and a method of effecting expression of siRNA precursors which adopt a hairpin structure. As an expression vector, for example, pSilencer siRNA Expression Vector (Ambion Inc.) can be used.

Below, as a specific example, a double stranded nucleic acid possessing an expression inhibiting effect due to RNA interference against expression of the polypeptide represented by SEQ ID NO: 87, which is encoded by the polynucleotide of SEQ ID NO: 88, is discussed.

First, after synthesizing each oligonucleotide pairs described in (A) to (F), they were respectively annealed and double stranded nucleic acids were obtained as sequences corresponding to a part of the nucleotide sequence of SEQ ID NO: 88.

```
                                            (SEQ ID NO: 185)
sense strand (A1)       5'- GUCCAGGAUAUCAUGAGUCTT -3'

(SEQ ID NO: 186)
antisense strand (B1)   3'- TTCAGGUCCUAUAGUACUCAG -5'

(SEQ ID NO: 187)
sense strand (A2)       5'- GAAGUCUGAAGAUCUAUCCTT -3'

(SEQ ID NO: 188)
antisense strand (B2)   3'- TTCUUCAGACUUCUAGAUAGG -5'

(SEQ ID NO: 189)
sense strand (A3)       5'- GCUGAAGAAGAGGUGUUCCTT -3'
```

```
                                                (SEQ ID NO: 190)
antisense strand (B3) 3'- TTCGACUUCUUCUCCACAAGG -5'

(SEQ ID NO: 191)
sense strand (A4)     5'- GAUGACACAGAUGAAGCCCTT -3'

(SEQ ID NO: 192)
antisense strand (B4) 3'- TTCUACUGUGUCUACUUCGGG -5'

(SEQ ID NO: 193)
sense strand (A5)     5'- GCCCUCAGAGUCCAGAAUCTT -3'

(SEQ ID NO: 194)
antisense strand (B5) 3'- TTCGGGAGUCUCAGGUCUUAG -5'

(SEQ ID NO: 195)
sense strand (A6)     5'- GAUGACUUUGGUAUCAAACTT -3'

(SEQ ID NO: 196)
antisense strand (B6) 3'- TTCUACUGAAACCAUAGUUUG -5'
(in oligonucleotides (A) to (F) above, A, U, G and
C represent each ribonucleotide, respectively, and
T represents deoxyribonucleotide.)
```

The above oligonucleotide pairs (A) to (F) are preferable non-limiting examples of oligonucleotide pairs (a) to (f) in above item (25).

Using EBNA cells (Invitrogen), the RNA interference effects possessed by the double stranded nucleic acids prepared from (A) to (F) above were confirmed. That is, using Lipofectamine 2000 (Invitrogen), an expression vector having the polynucleotide of SEQ ID NO:88, pNFkB-Luc, phRL-TK vector and double stranded nucleic acid (A) were co-transfected into EBNA cells, and after culturing, luciferase activity was measured. As a result, it was found that the activity of cells into which double stranded nucleic acid (A) had been co-transfected was markedly lower in comparison with the activity of cells into which double stranded nucleic acid had not been introduced. This result indicated that the double stranded nucleic acid (A) markedly inhibited the expression of the protein represented by SEQ ID NO: 87.

Also, in the case where the double stranded nucleic acid of (B), (C), (D), (E) or (F) was co-transfected, it was found that expression of the protein represented by SEQ ID NO: 87, was similarly inhibited.

Therefore, because the double stranded nucleic acids of (A) to (F) above possessed an effect of inhibiting expression of the protein represented by SEQ ID NO:87, they are useful as expression inhibiting agents in respect of the protein represented by SEQ ID NO: 87.

Next, an expression vector (pUH1) to enable intracellular expression of siRNA was prepared.

```
                                                (SEQ ID NO: 197)
    5'-AAAAGTCCAGGATATCATGAGTCTTTTTTA (SEQ ID NO: 198)
    5'-AGCTTAAAAAAGACTCATGATATCCTGGAC (SEQ ID NO: 199)
(H) 5'-AAAAGAAGTCTGAAGATCTATCCTTTTTA (SEQ ID NO: 200)
    5'-AGCTTAAAAAAGGATAGATCTTCAGACTTC (SEQ ID NO: 201)
(I) 5'-AAAAGCTGAAGAAGAGGTGTTCCTTTTTA (SEQ ID NO: 202)
    5'-AGCTTAAAAAAGGAACACCTCTTCTTCAGC (SEQ ID NO: 203)
    5'-AAAAGATGACACAGATGAAGCCCTTTTTTA (SEQ ID NO: 204)
    5'-AGCTTAAAAAAGGGCTTCATCTGTGTCATC (SEQ ID NO: 205)
    5'-AAAAGCCCTCAGAGTCCAGAATCTTTTTTA (SEQ ID NO: 206)
    5'-AGCTTAAAAAAGATTCTGGACTCTGAGGGC (SEQ ID NO: 207)
    5'-AAAAGATGACTTTGGTATCAAACTTTTTTA (SEQ ID NO: 208)
    5'-AGCTTAAAAAAGTTTGATACCAAAGTCATC
```

The oligonucleotide pairs of (G) to (L) above were then synthesized. Thereafter, each oligonucleotide pair were respectively annealed to obtain double stranded DNA, and expression vectors for expression of siRNA (pUH88-1, pUH88-2, pUH88-3, pUH88-4, pUH88-5 and pUH88-6) were prepared.

The RNA interference effect possessed by the expression vectors for expression of siRNA (pUH88-1, pUH88-2, pUH88-3, pUH88-4, pUH88-5 and pUH88-6) was confirmed using EBNA cells (Invitrogen). That is to say, an expression vector having a polynucleotide of SEQ ID NO: 88, pNFkB-Luc, phRL-TK vector and pUH88-1 were co-transfected into EBNA cells using FuGENE6, and after culturing luciferase activity was measured. As a result, it was found that the activity of a cell into which pUH88-1 was co-transfected was markedly low in comparison to the activity of a cell into which pUH1 was co-transfected, which was used as a control. This result indicated that siRNA, expressed intracellularly by pUH88-1, markedly inhibited expression of the protein represented by SEQ ID NO: 87.

In cases where pUH88-2, pUH88-3, pUH88-4, pUH88-5 or pUH88-6 was co-transfected, it was found that expression of the protein represented by SEQ ID NO: 87 was similarly markedly inhibited.

Therefore, because the expression vector for expression of the above described siRNA, has an effect of inhibiting expression of the protein represented by SEQ ID NO: 87, it is useful as an expression inhibiting agent in respect of the protein represented by SEQ ID NO:87.

Further, the present invention encompasses double stranded nucleic acids, and vectors expressing these double stranded nucleic acids, which have activity to inhibit expression of the protein of SEQ ID NO: 87 and which are formed by annealing of an antisense strand having a sequence including an antisense sequence of a antisense strand described in (A) to (F) above with 1 to 4 bases at the 3' end which protrude when annealed with a sense strand (overhang); and a sense strand having a sequence including a sense sequence of a sense strand described in (A) to (F) above with 1 to 4 bases at the 3' end which protrude when annealed with an antisense strand (overhang).

The double stranded nucleic acids of the present invention for the polynucleotide of the present invention, and the vectors which express these double stranded nucleic acids are useful as expression inhibiting agents in respect of the polynucleotide of the present invention. Further, they are useful as a medicament for the treatment or prevention of diseases characterized by undesirable activation of NF-κB such as inflammation, auto-immune disease, infection, cancer, etc. The present invention also encompasses a pharmaceutical composition comprising the above double stranded nucleic acids and/or the above expression vectors, as an active ingredient.

The double-stranded nucleic acid of the present invention can be used to examine at what position the polypeptide encoded by the gene of the present invention functions in the signal transduction pathway which brings about NF-κB activation. Specific examples include the identification of the functioning position of the polypeptide encoded by the gene of the present invention represented by SEQ ID NO: 88 by using the double-stranded nucleic acid of the present invention prepared using oligonucleotides having nucleotide sequences represented by SEQ ID NOs: 185-196.

From a different viewpoint, a polypeptide having an action of activating NF-κB encoded by a gene of the present invention whose functioning position has been identified using the double-stranded nucleic acid of the present invention, and the gene of the present invention, are useful, for example, as targets for new drug development and/or as aides to developmental research. Specific examples include a polypeptide encoded by the gene of the present invention represented by SEQ ID NO: 88 whose functioning position has been identified by the double-stranded nucleic acid of the present invention prepared using oligonucleotides having nucleotide sequences represented by SEQ ID NOs: 185-196.

The above described experiment can be conducted, for example, in the following manner. A double-stranded nucleic acid prepared corresponding to a gene of the present invention is introduced into a suitable cell, and the cell is subjected to various suitable stimuli which activate NF-κB, and the observed pattern of inhibition of NF-κB activation is analyzed in detail, and the position at which the polypeptide encoded by the gene of SEQ ID NO: 88 is identified. Examples of suitable cells include HEK293 (ATCC CRL1573), HeLa (ATCC CCL2.2), MRC-5 (ATCC CCL171), THP-1 (ATCC TIB-202), RAW264.7 (ATCC TIB-71), Normal Human lung fibroblast (Cryo NHLF: Sanko Junyaku Co. Ltd.) and the like. Examples of various suitable stimuli include those induced by IL-1, TNF, lipopolysaccharide, double-stranded RNA, bacterial lipopeptides, unmethylated CpG DNA and the like.

The present invention, moreover, relates to a process for obtaining a new gene having a function, which comprises using the oligo-capping method to construct a full-length cDNA library, and using a signal factor indicative of the presence of a protein having the function. An example of such signal factor is a reporter gene.

Methods using a cDNA library containing a lot of non-full-length cDNAs are inefficient in obtaining many genes (cDNAs) having functions. Therefore libraries with a high ratio of the number of the full-length cDNA clones to the total number of the clones are necessary. "Full-length cDNA" refers to a complete DNA copy of mRNA from a gene. The cDNA libraries produced using the oligo-capping method contain full-length cDNA clones in a ratio of 50 to 80%, namely, a 5 to 10-fold increase in full-length cDNA clones compared to the cDNA libraries produced by prior art methods (Sumio Sugano, the monthly magazine BIO INDUSTRY Vol. 16, No. 11, p. 19-26). Full-length cDNA clones are essential for protein expression in functional analyses of genes, and full-length cDNA clones themselves are very important materials for activity measurement. Thus, cloning of full-length cDNA is necessary for functional analyses of genes. Sequencing of the cDNA not only provides important information for establishing the primary sequence of the protein encoded by the cDNA, but also reveals the entire exon sequence. Thus, the full-length cDNA provides valuable information for identifying a gene, such as information for determining the primary sequence of a protein, exon-intron structure, the transcription initiation site of mRNA, the location of a promoter, etc.

The construction of full-length cDNA libraries by the oligo-capping method can be carried out, for example, according to the method described in "Shin Idenshi Kougaku Handbook (New Genetic Engineering Handbook)", the third edition (1999), an extra issue of "Jikken Igaku (Experimental Medicine)", YODOSHA CO., LTD. The reporter gene indicative of the presence of a protein having a function contains one or more suitable expression regulation sequence portion to which a protein factor such as a transcriptional factor can bind, and a structural gene portion which allows the measurement of the activation of the proteins factor. The structural gene portion may encode any peptide or protein so long as those skilled in the art can measure the activity or amount of its expression product (including the amount of the mRNA produced). For example, chloramphenicol acetyltransferase, β-galactosidase, luciferase, etc., can be used and their enzymatic activity measured.

The oligo-capping method used herein involves substituting a cap structure with a synthetic oligo sequence by using BAP, TAP and an RNA ligase, as described in Suzuki & Sugano, "Shin Idenshi Kougaku Handbook (New Genetic Engineering Handbook)", the third edition (1999), an extra issue of "Jikken Igaku (Experimental Medicine)", YODOSHA CO., LTD.

The process of the present invention uses an in vitro system or a cell-based system, preferably a cell-based system. Examples of such cells include cells of prokaryotes such as E. coli, microorganisms such as yeast and fungi, as well as insects and animals. Preferred examples include animal cells, in particular, 293-EBNA cells and NIH3T3 cells.

Examples of reporter genes indicative of the presence of a protein having a function include reporter genes containing a CREB (cAMP responsive element binding protein) binding sequence or AP-1 (activator protein-1) binding sequence at the expression regulation sequence region of the reporter genes, in addition to the NF-κB reporter genes described herein. For example, if a gene capable of activating CREB is to be obtained, a CREB-dependent reporter plasmid and an expression vector comprising full-length cDNA produced by the oligo-capping method can be cotransfected into cells, and an expression vector having increased reporter activity can be selected from the cells to attain the purpose. If a gene capable of inhibiting CREB is to be obtained, a CREB-dependent reporter plasmid and an expression vector comprising full-length cDNA produced by the oligo-capping method can be cotransfected into cells, and an expression vector having decreased reporter activity can be selected from the cells to attain the purpose. These procedures may be carried out in the presence of a certain stimulus to the cells. The cDNA clone (expression vector) to be transfected into the cells may be a single clone or multiple clones which may be transfected simultaneously. One embodiment of the process of the present invention is detailed in Examples herein. Alternatively, a screening system for obtaining a gene capable of inhibiting NF-κB activation can also be constructed by cotransfecting an expression vector comprising full-length cDNA and a reporter gene into cells, stimulating the cells with IL-1 or TNF-α and the like, and selecting a clone having subnormally increased reporter activity.

However, the process of the present invention is not limited to these embodiments.

Because the cDNA of the present invention is full-length, its 5' end sequence is the transcription initiation site of the corresponding mRNA. Therefore the cDNA sequence can be used to identify the promoter region of the gene by comparing the cDNA with the genomic nucleotide sequence. Genomic nucleotide sequences are available from various databases when the sequences have been deposited in the databases. Alternatively, the cDNA can also be used to clone the desired sequence from a genomic library, for example, by hybridization, and determine its nucleotide sequence. Thus, by comparing the nucleotide sequence of the cDNA of the present invention with a genomic sequence, the promoter region of the gene located upstream the cDNA can be identified. In addition, the promoter fragment thus identified can be used to construct a reporter plasmid for evaluating the expression of the gene. In general, the DNA fragment spanning 2 kb (preferably 1 kb) upstream from the transcription initiation site can be inserted upstream of the reporter gene to produce the reporter plasmid. The reporter plasmid can be used to screen for a compound which enhances or reduces the expression of the gene. For example, such screening can be carried out by transforming a suitable cell with the reporter plasmid, culturing the transformed cell for a certain period of time, adding a certain amount of a test compound, measuring the reporter activity expressed by the cell after a certain period of time, and comparing the activity with that of a cell to which the test compound has not been added. These methods are also included in the scope of the present invention.

The present invention also relates to a computer-readable medium on which a sequence data set has been stored, said sequence data set comprising at least one nucleotide sequence selected from the group consisting of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179, and/or at least one amino acid sequence selected from the group consisting of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180.

In another aspect, the present invention relates to a method for calculating a homology, which comprises comparing data on the above medium with data of other nucleotide sequences. Thus, the gene and amino acid sequence of the present invention provide valuable information for determining their secondary and tertiary structure, e.g., information for identifying other sequence having a similar function and high homology. These sequences are stored on the computer-readable medium, then a database is searched using data stored in a known macromolecule structure program and a known search tool such as GCG. In this manner, a sequence in a database having a certain homology can be easily found.

The computer-readable medium may be any composition of materials used to store information or data. Examples of such media include commercially available floppy disks, tapes, chips, hard drives, compact disks and video disks. The data on the medium allows a method for calculating a homology by comparing the data with other nucleotide sequence data. This method comprises the steps of providing a first polynucleotide sequence containing the polynucleotide sequence of the present invention for the computer-readable medium, and then comparing the first polynucleotide sequence with at least one-second polynucleotide or polypeptide sequence to identify the homology.

The present invention also relates to an insoluble substrate to which polynucleotide comprising all or part of the nucleotide sequences selected from the group consisting of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179, are fixed. A plurality of the various polynucleotides which are DNA probes are fixed on a specifically processed solid substrate such as slide glass to form a DNA microarray and then a labeled target polynucleotide is hybridized with the fixed polynucleotides to detect a signal from each of the probes. The data obtained is analyzed and the gene expression is determined.

The present invention further relates to an insoluble substrate to which polypeptides comprising all or part of the amino acid sequences selected from the group consisting of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180, are fixed. By mixing organism-derived cell extract with the insoluble substrate on which these proteins are fixed, it is possible to isolate or identify cell-derived components such as proteins captured on the insoluble substrate that can be expected to be useful in diagnosis or drug development.

EXAMPLES

The following examples further illustrate, but do not limit the present invention.

Example 1

Construction of a Full-Length cDNA Library Using the Oligo-Capping Method Preparation of RNA from Human Lung Fibroblasts (Cryo NHLF)

Human lung fibroblasts (Cryo NHLF: purchased from Sanko Junyaku Co., Ltd.) were cultured according to the attached protocol. After repeating subculturing the cells to obtain fifty 10 cm dishes containing the resulting culture, the cells were recovered with a cell scraper. Then, total RNA was obtained from the recovered cells by using the RNA extraction reagent ISOGEN (purchased from NIPPON GENE) according to the manufacturer's protocol. Then, poly A+ RNA was obtained from the total RNA by using an oligo-dT cellulose column according to Maniatis et al., supra.

(2) Preparation of RNA from Mouse ATDC5 Cells

ATDC5, a cell strain cloned from mouse EC (embryonal carcinoma) (Atsumi, T. et al.: Cell Diff. Dev., 30: p 109-116) (1990) was repeatedly subcultured to obtain fifty 10 cm dishes containing the resultant culture. Thereafter, poly A+ RNA was obtained by a method similar to that of (1) above. Culture of ATDC5 cells was performed according to the method described in Atsumi, T. et al.: Cell Diff. Dev., 30: p 109-116 (1990).

(3) Construction of a Full-Length cDNA Library by the Oligo-Capping Method

A full-length cDNA library was constructed from poly A+ RNA of the above human lung fibroblasts and ATDC5 cells by the oligo-capping method according to the method of Sugano S. et al. [e.g., Maruyama, K. & Sugano, S., Gene, 138:171-174 (1994); Suzuki, Y. et al., Gene, 200:149-156 (1997); Suzuki, Y. & Sugano, S. "Shin Idenshi Kougaku Handbook (New Genetic Engineering Handbook)", the third edition (1999), an extra issue of "Jikken Igaku (Experimental Medicine)", YODOSHA CO., LTD.].

(4) Preparation of Plasmid DNA

The full-length cDNA library constructed as above was transfected into E. coli strain TOP 10 by electroporation, then spread on LB agar medium containing 100 µg/ml of ampicillin, and incubated overnight at 37° C. Then, using QIAwell 96 Ultra Plasmid Kit (QIAGEN) according to the manufacturer's protocol, the plasmids were recovered from the colonies grown on ampicillin-containing LB agar medium.

Example 2

Cloning of DNA Capable of Activating NF-κB (1) Screening of the cDNA Encoding the Protein Capable of Activating NF-κB 293-EBNA cells (purchased from Invitrogen) were grown to 1×104 cells/100 µl/well in a 96 well plate for cell culture for 24 hours at 37° C. (in the presence of 5% CO2) using 5% FBS containing DMEM medium. Then, 50 ng of pNF κB-Luc (purchased from STRATAGENE) and 2 µl of the full-length cDNA expression vector prepared in above Example 1. (4) were cotransfected into the cells in a well using FuGENE 6 (purchased from Roche) according to the manufacturer's protocol. After 24 hours of culture at 37° C., the reporter activity of NF-κB (luciferase activity) was measured using long-term luciferase assay system, PIKKA GENE LT2.0 (TOYO INK) according to the attached manufacturer's instructions. The luciferase activity was measured using Wallac ARVOTMST 1420 MULTILABEL COUNTER (Perkin Elmer).

(2) DNA Sequencing

The above screening was carried out for 155,000 clones, and plasmids showing a 5-fold or more increase in luciferase activity compared to that of the control experiment (luciferase activity of the cell into which vacant vector pME18S-FL3 is introduced instead of full-length cDNA expression vector) were selected. One pass sequencing was carried out from the 5' end of the cloned cDNA (sequencing primer: 5'-CTTCT-GCTCTAAAAGCTGCG-3' (SEQ ID NO: 181)) and from the 3' end (sequencing primer: 5'-CGACCTGCAGCTCGAG-CACA-3' (SEQ ID NO: 182)) so that as long sequence as possible is determined. The sequencing was carried out using the reagent Thermo Sequenase II Dye Terminator Cycle Sequencing Kit (Amersham Pharmacia Biotech) or BigDye Terminator Cycle Sequencing FS Ready Reaction Kit (Applied Biosystems) and the device ABI PRISM 377 sequencer or ABI PRISM 3100 sequencer according to the manufacturer's instructions.

(3) Database Analysis of the Obtained Clones

BLAST (Basic local alignment search tool) searching [S. F. Altschul et al., J. Mol. Biol., 215:403-410 (1990)] was carried out in GenBank for the obtained nucleotide sequence. The results showed that 148 clones represented 90 genes encoding new proteins capable of activating NF-κB.

(4) Full-Length Sequencing

The full-length DNA sequences for the 90 new clones were determined (SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 151, 153, 155, 157, 159, 161, 163, 165, 167, 169, 171, 173, 175, 177 and 179). The amino acid sequences of the protein coding regions (open reading frames) were deduced (SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 152, 154, 156, 158, 160, 162, 164, 166, 168, 170, 172, 174, 176, 178 and 180).

Example 3

Screening Compounds Inhibiting NF-κB Activation

Figure 2:
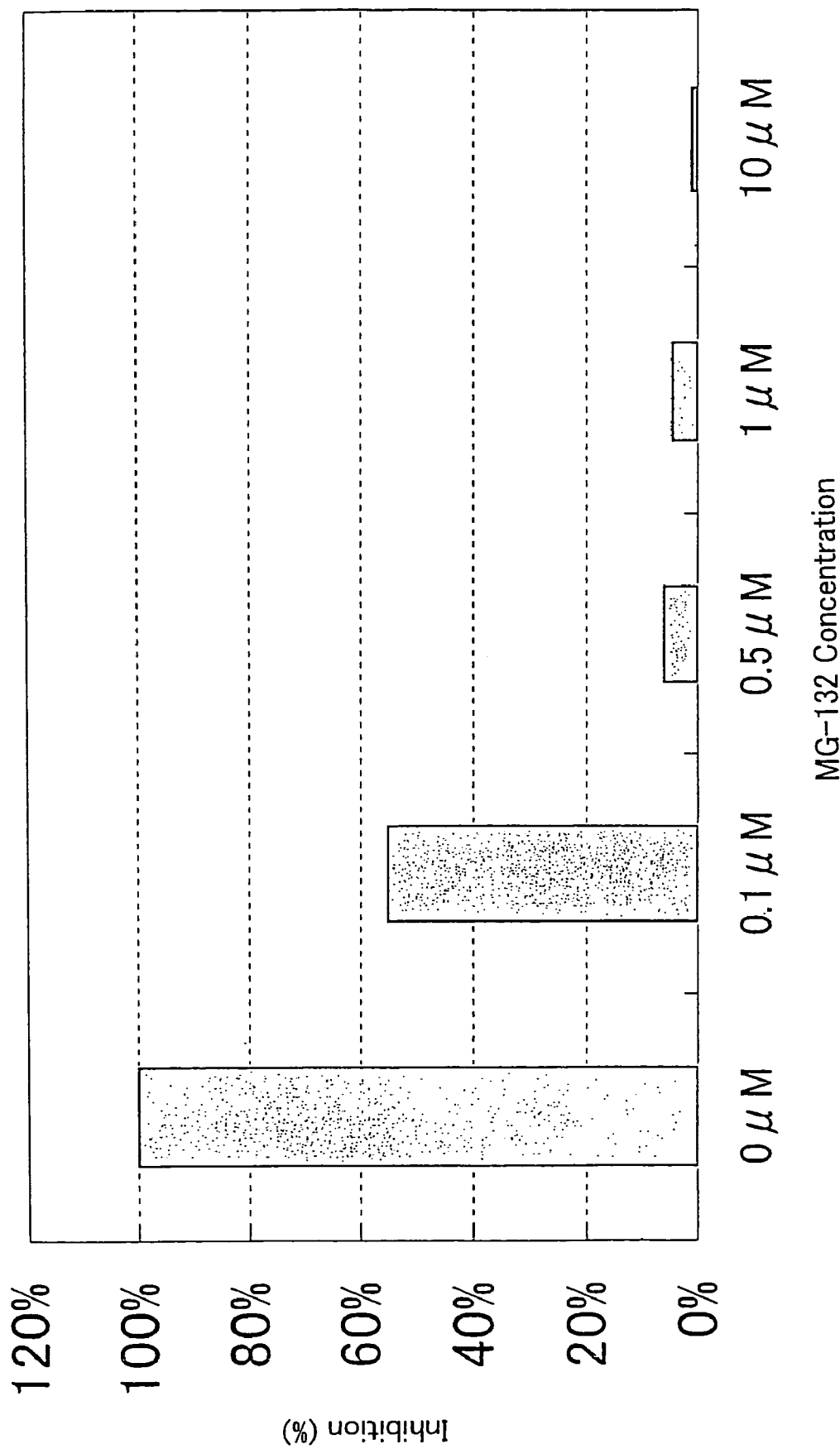
FIG. 2 is a graph showing NF-κB reporter activity inhibition by the proteasome inhibitor MG-132 (SEQ ID NO: 9) in Example 3.
Figure 3:
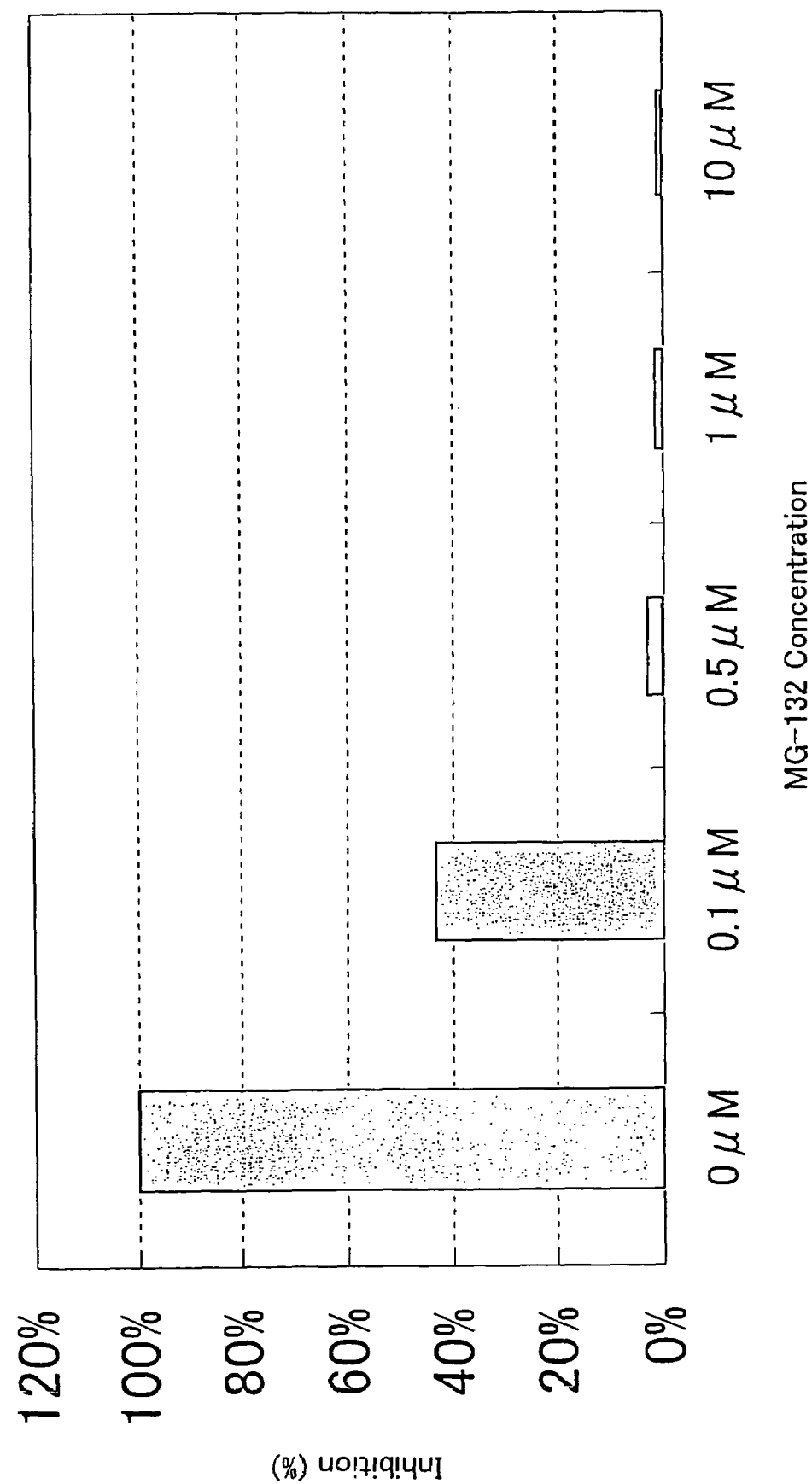
FIG. 3 is a graph showing NF-κB reporter activity inhibition by the proteasome inhibitor MG-132 (SEQ ID NO: 17) in Example 3.
Figure 4:
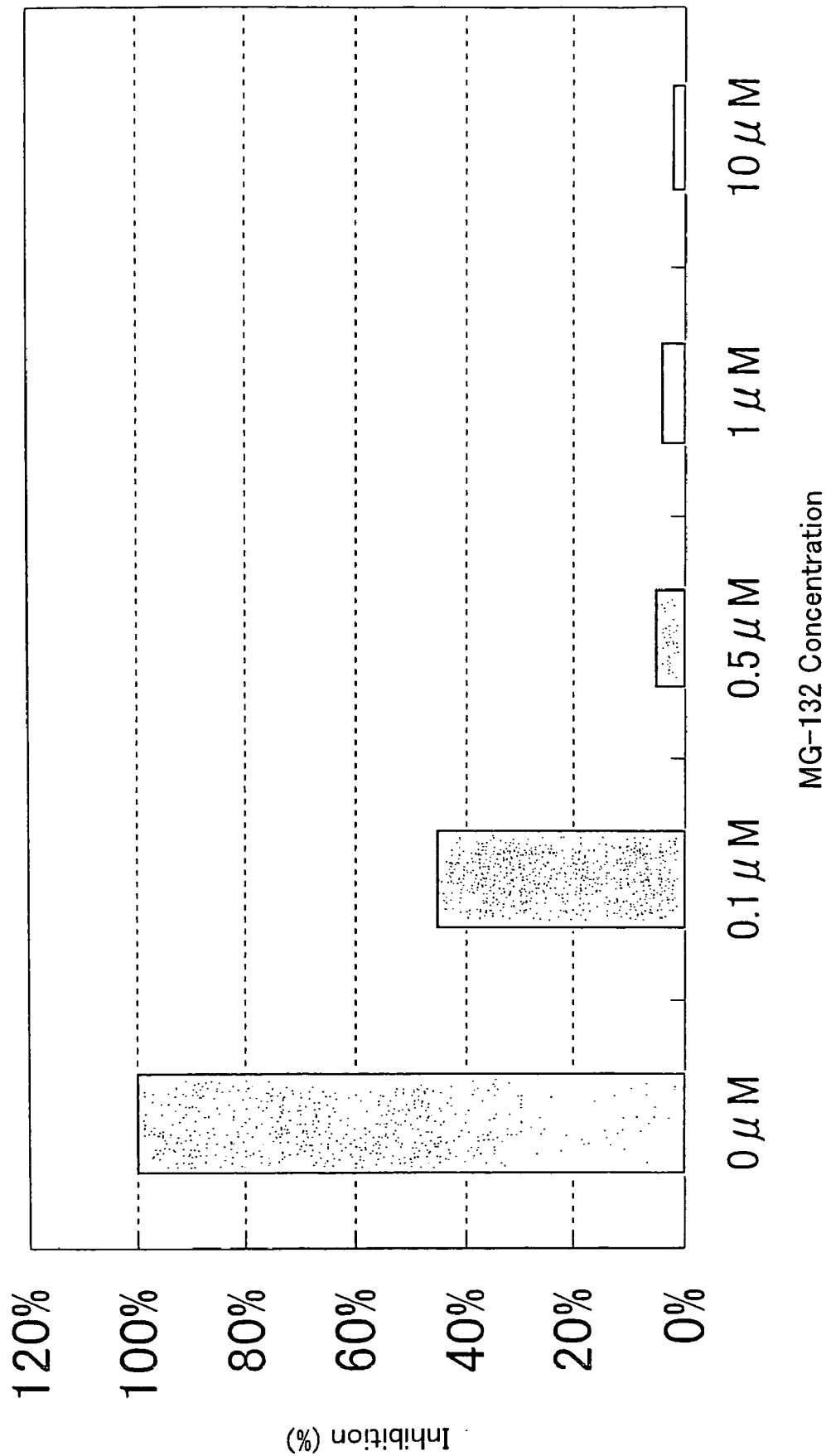
FIG. 4 is a graph showing NF-κB reporter activity inhibition by the proteasome inhibitor MG-132 (SEQ ID NO: 21) in Example 3.
Figure 5:
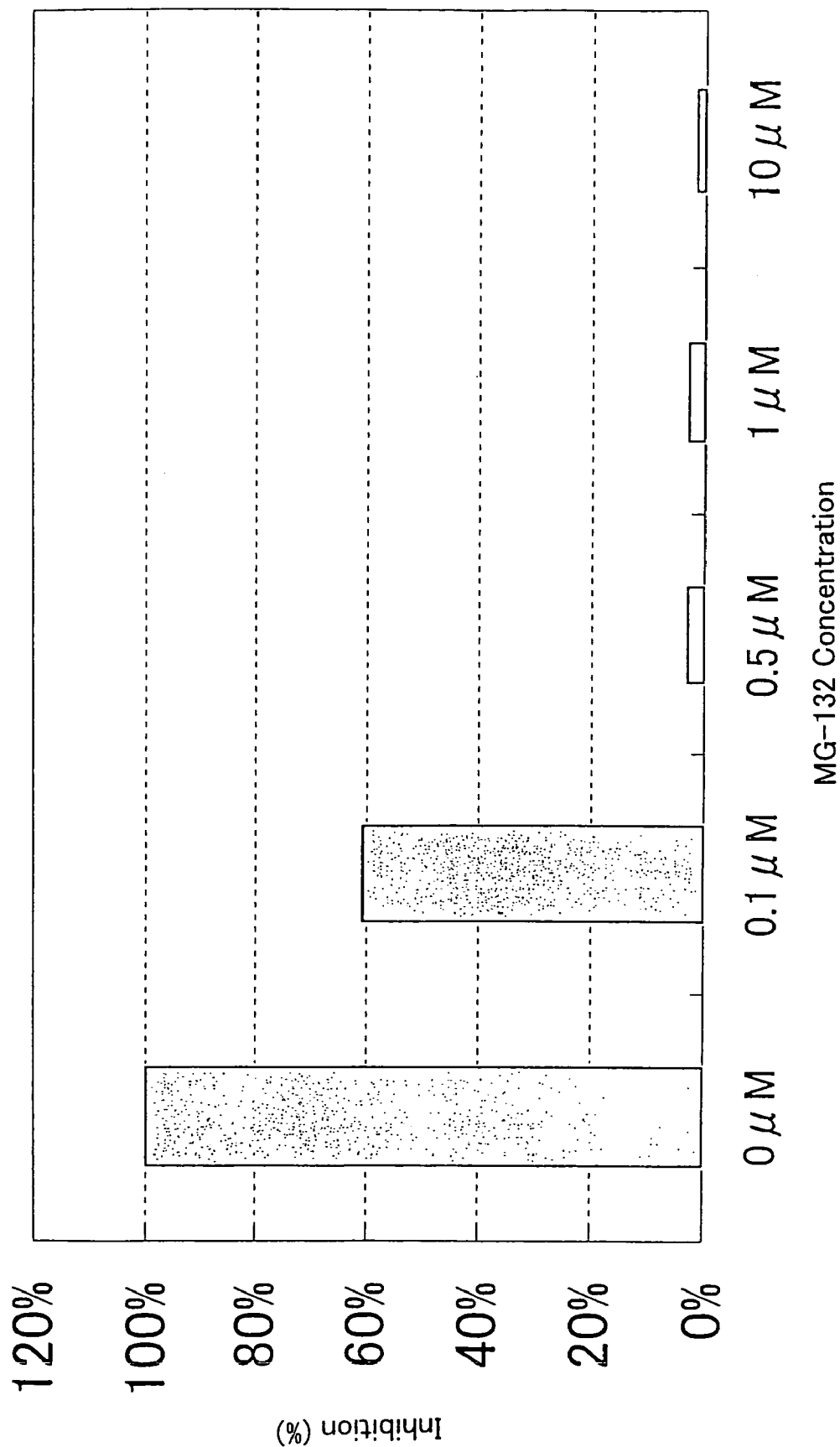
FIG. 5 is a graph showing NF-κB reporter activity inhibition by the proteasome inhibitor MG-132 (SEQ ID NO: 35) in Example 3.
Figure 6:
FIG. 6 is a graph showing NF-κB reporter activity inhibition by the proteasome inhibitor MG-132 (SEQ ID NO: 37) in Example 3.
Figure 7:
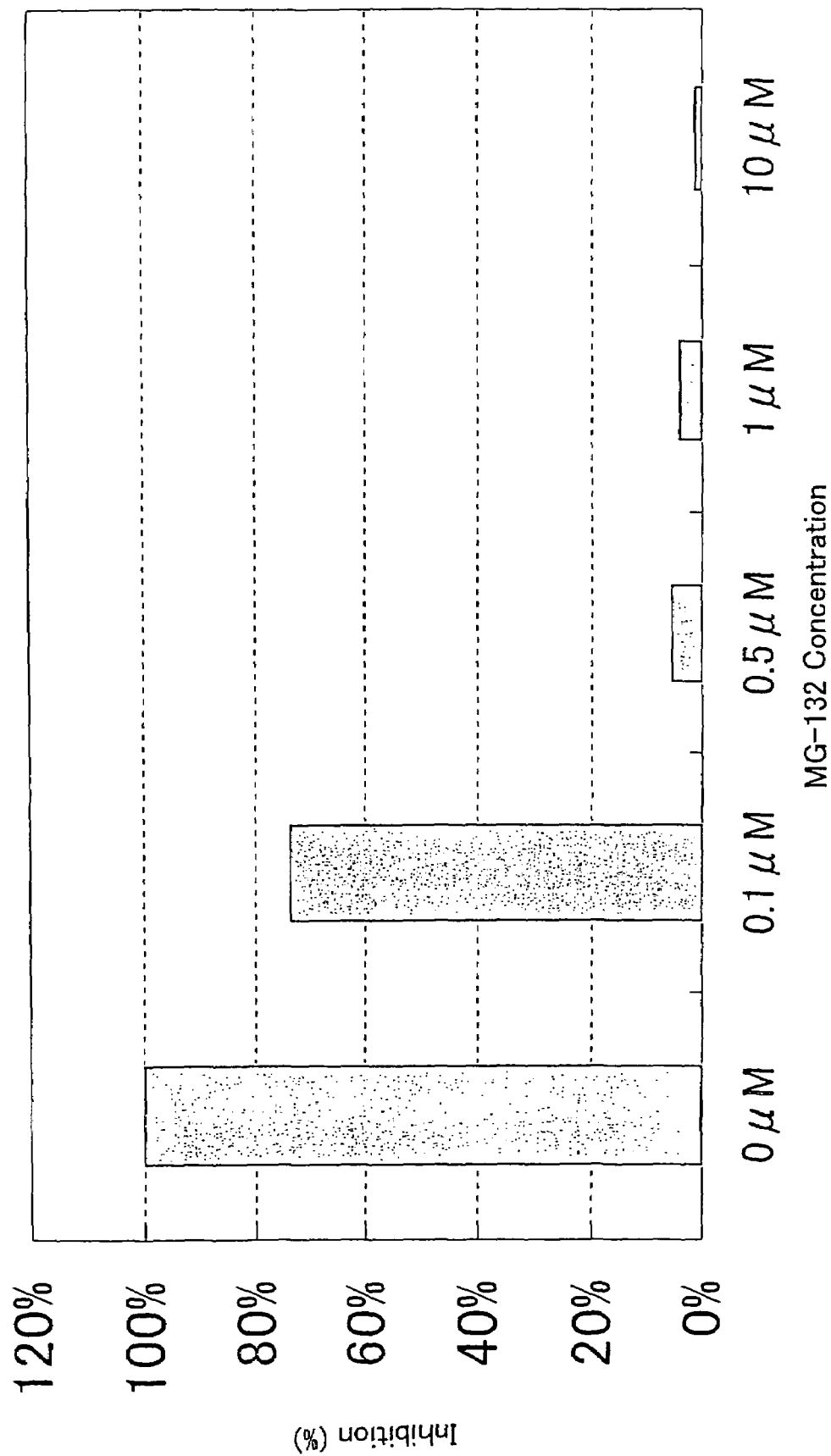
FIG. 7 is a graph showing NF-κB reporter activity inhibition by the proteasome inhibitor MG-132 (SEQ ID NO: 41) in Example 3.
Figure 8:
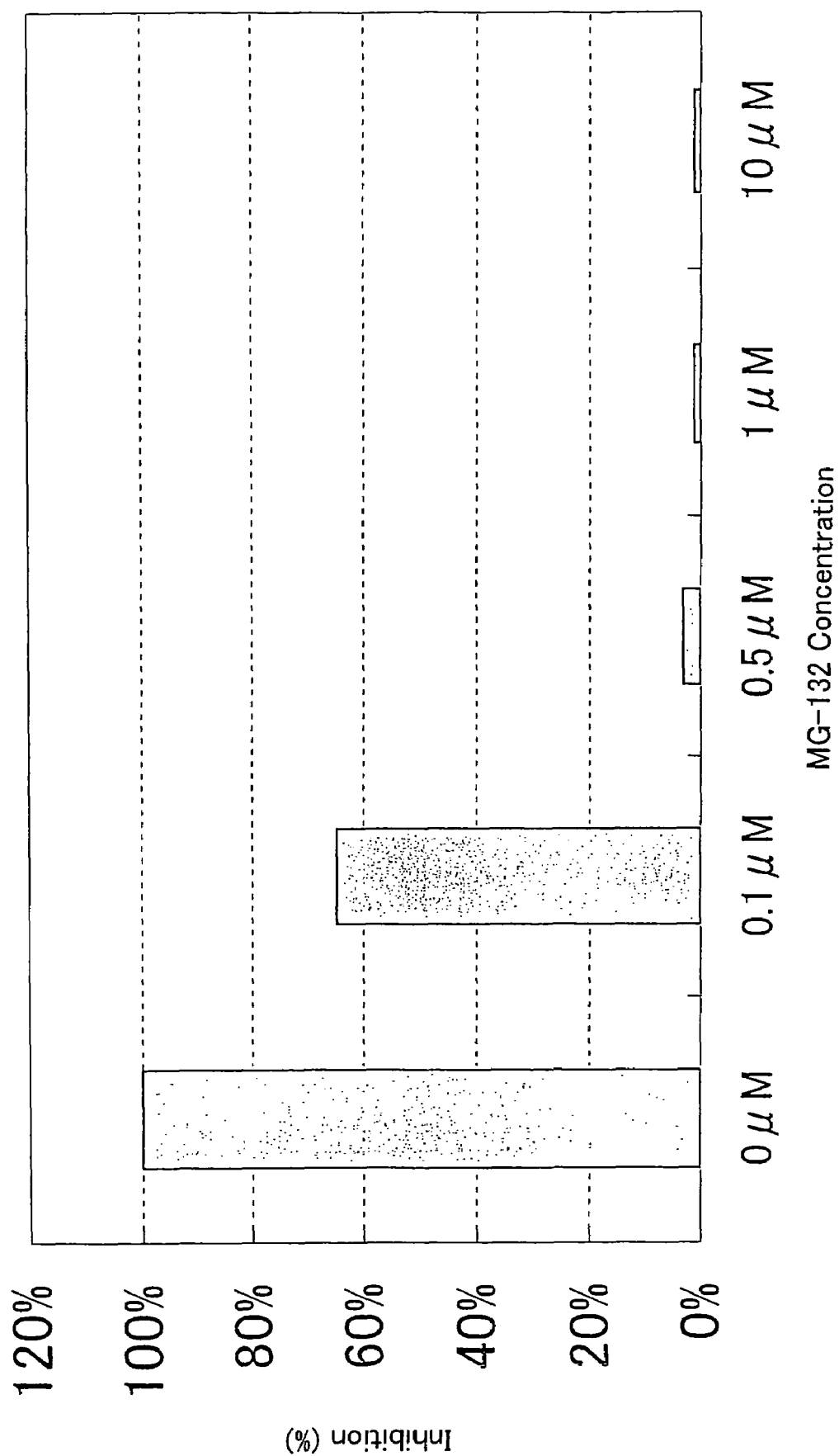
FIG. 8 is a graph showing NF-κB reporter activity inhibition by the proteasome inhibitor MG-132 (SEQ ID NO: 53) in Example 3.
Figure 9:
FIG. 9 is a graph showing NF-κB reporter activity inhibition by the proteasome inhibitor MG-132 (SEQ ID NO: 57) in Example 3.
Figure 10:
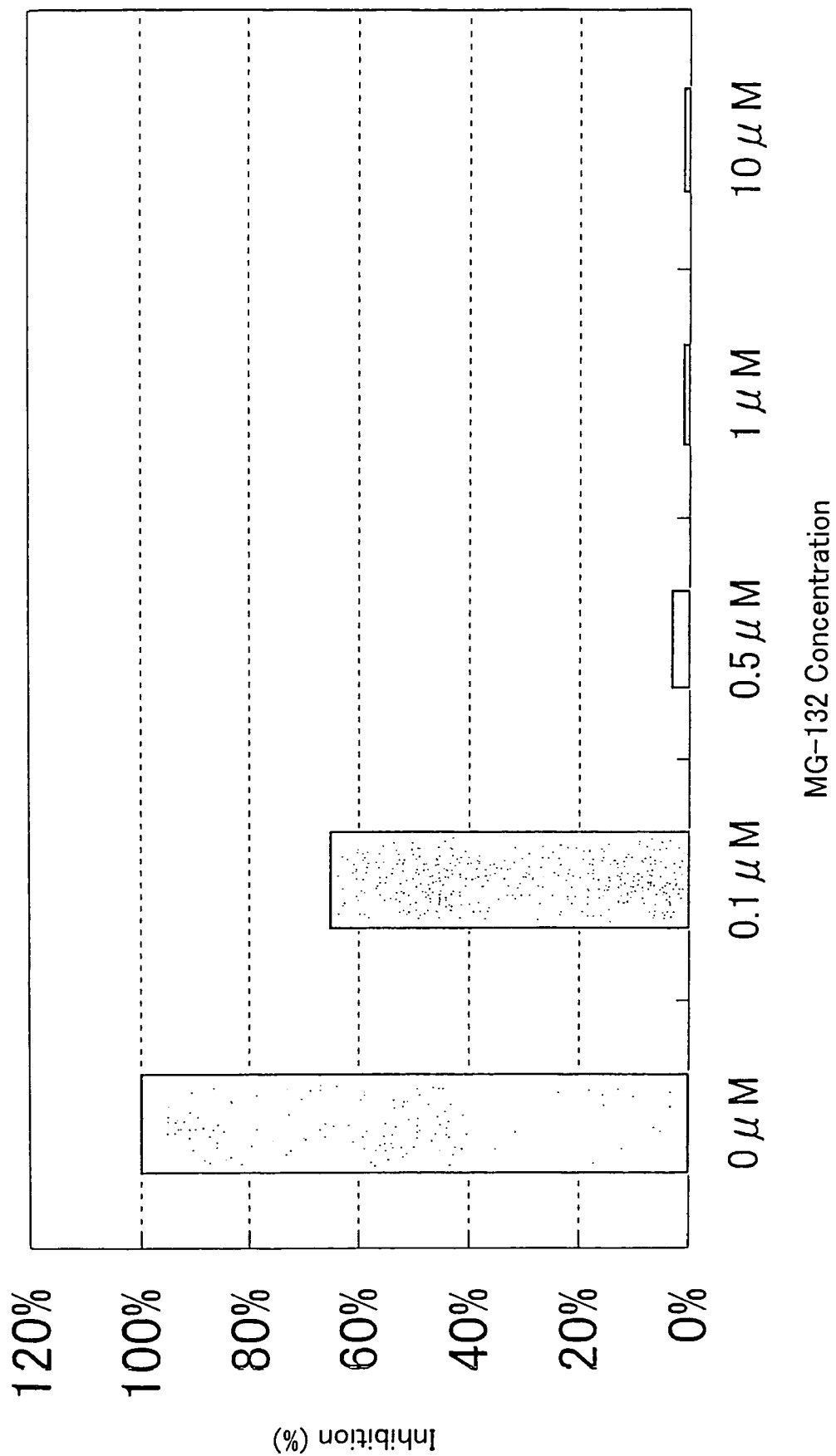
FIG. 10 is a graph showing NF-κB reporter activity inhibition by the proteasome inhibitor MG-132 (SEQ ID NO: 63) in Example 3.
Figure 11:
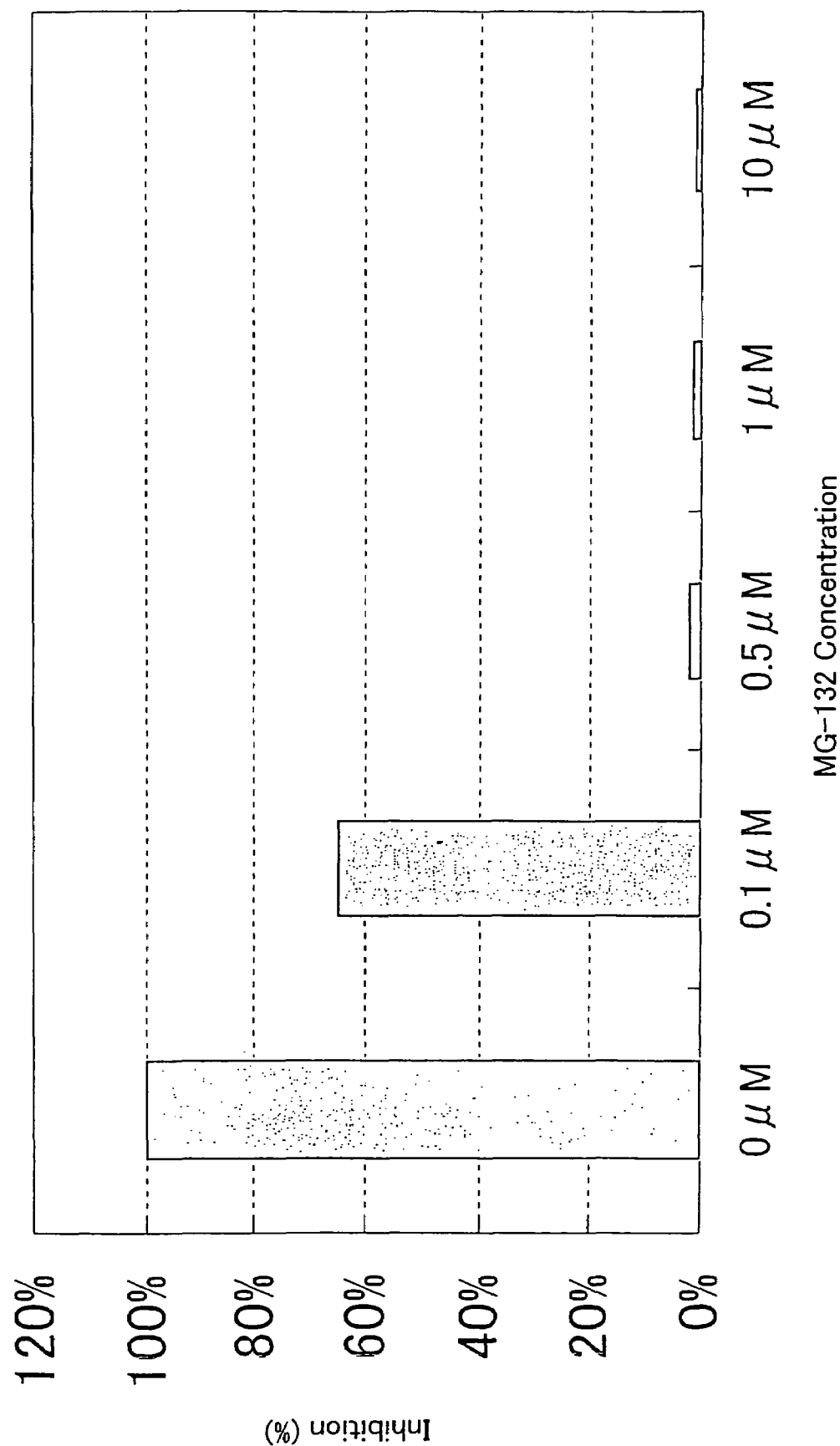
FIG. 11 is a graph showing NF-κB reporter activity inhibition by the proteasome inhibitor MG-132 (SEQ ID NO: 67) in Example 3.
Figure 12:
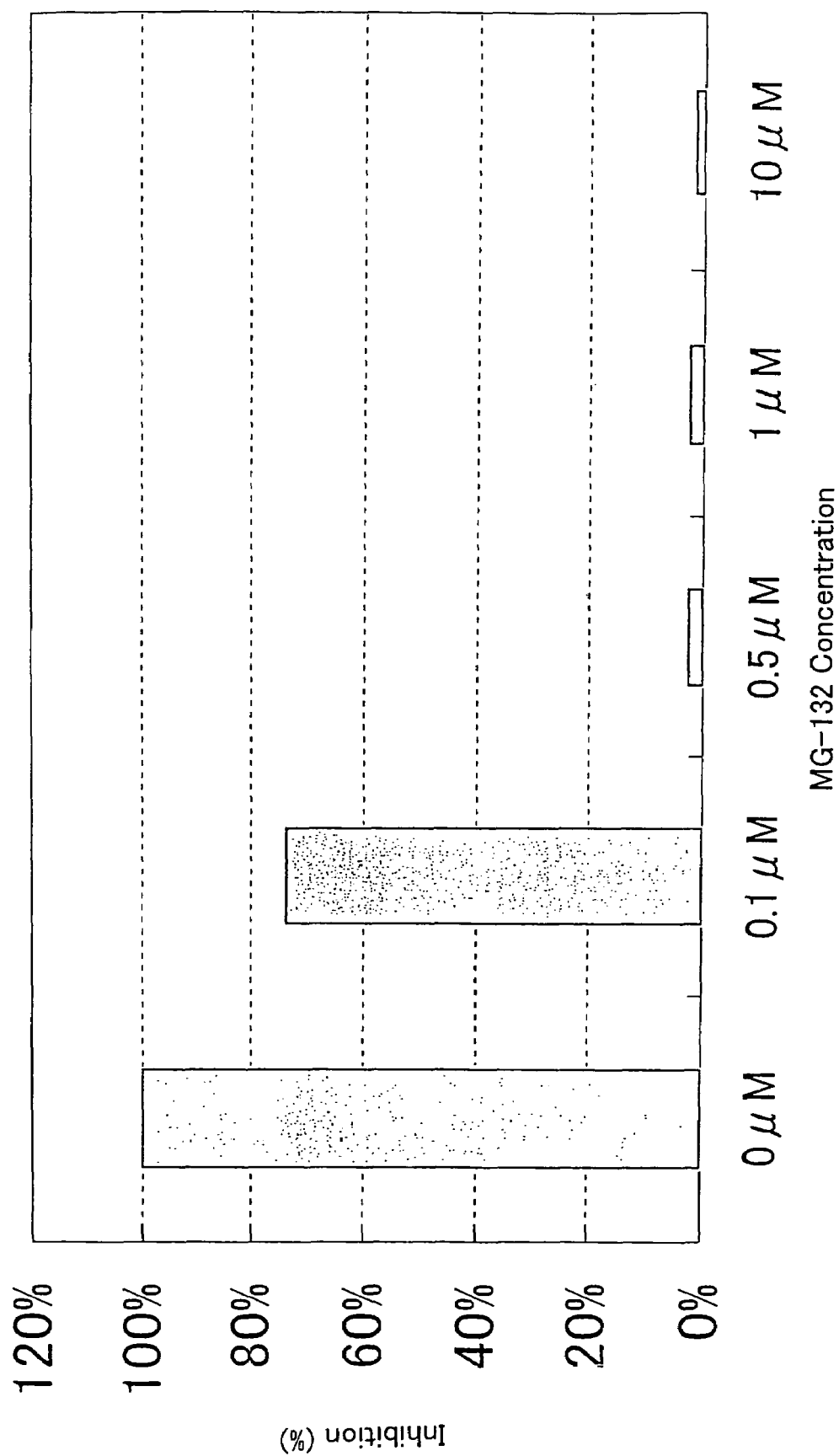
FIG. 12 is a graph showing NF-κB reporter activity inhibition by the proteasome inhibitor MG-132 (SEQ ID NO: 71) in Example 3.
Figure 13:
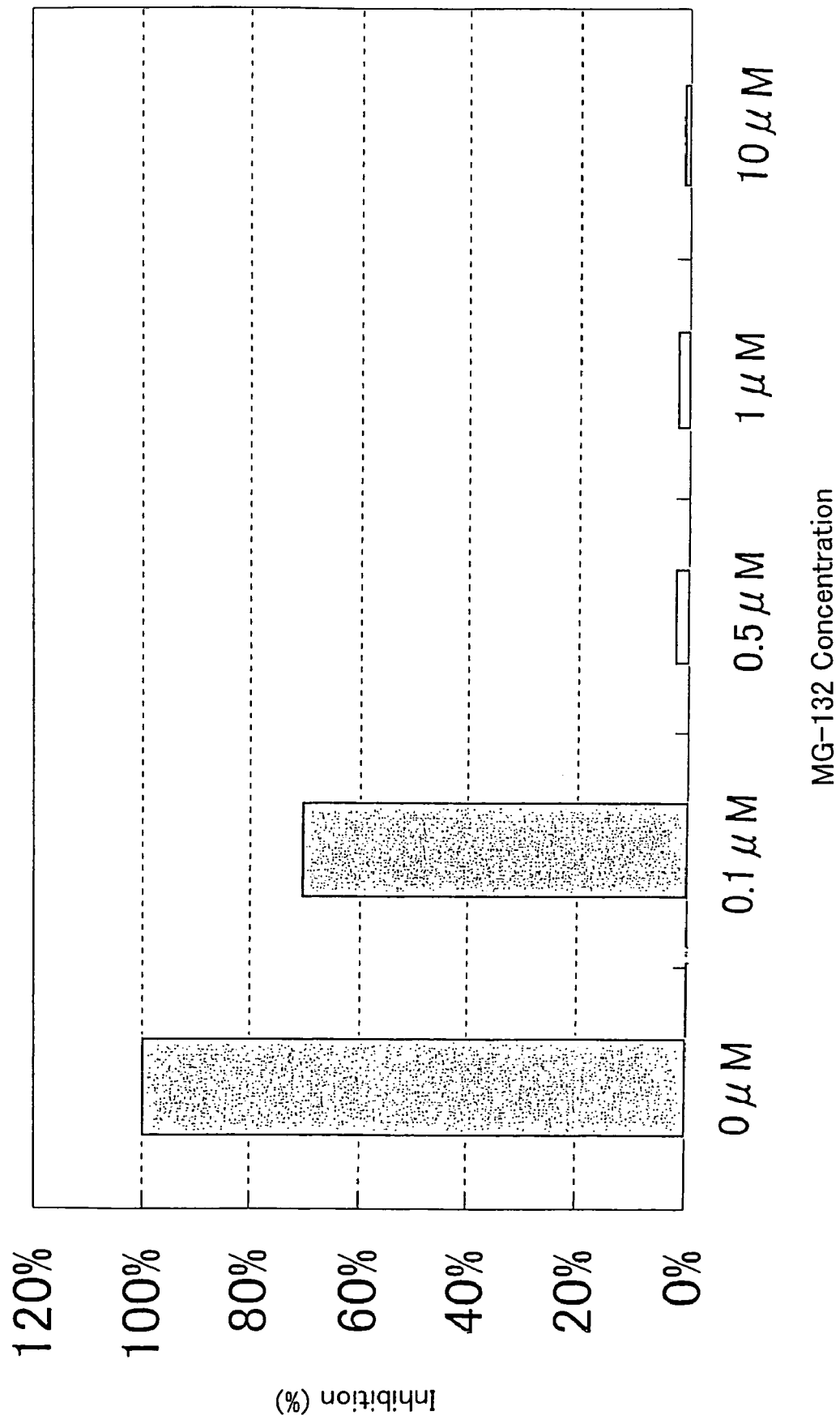
FIG. 13 is a graph showing NF-κB reporter activity inhibition by the proteasome inhibitor MG-132 (SEQ ID NO: 75) in Example 3.
Figure 14:
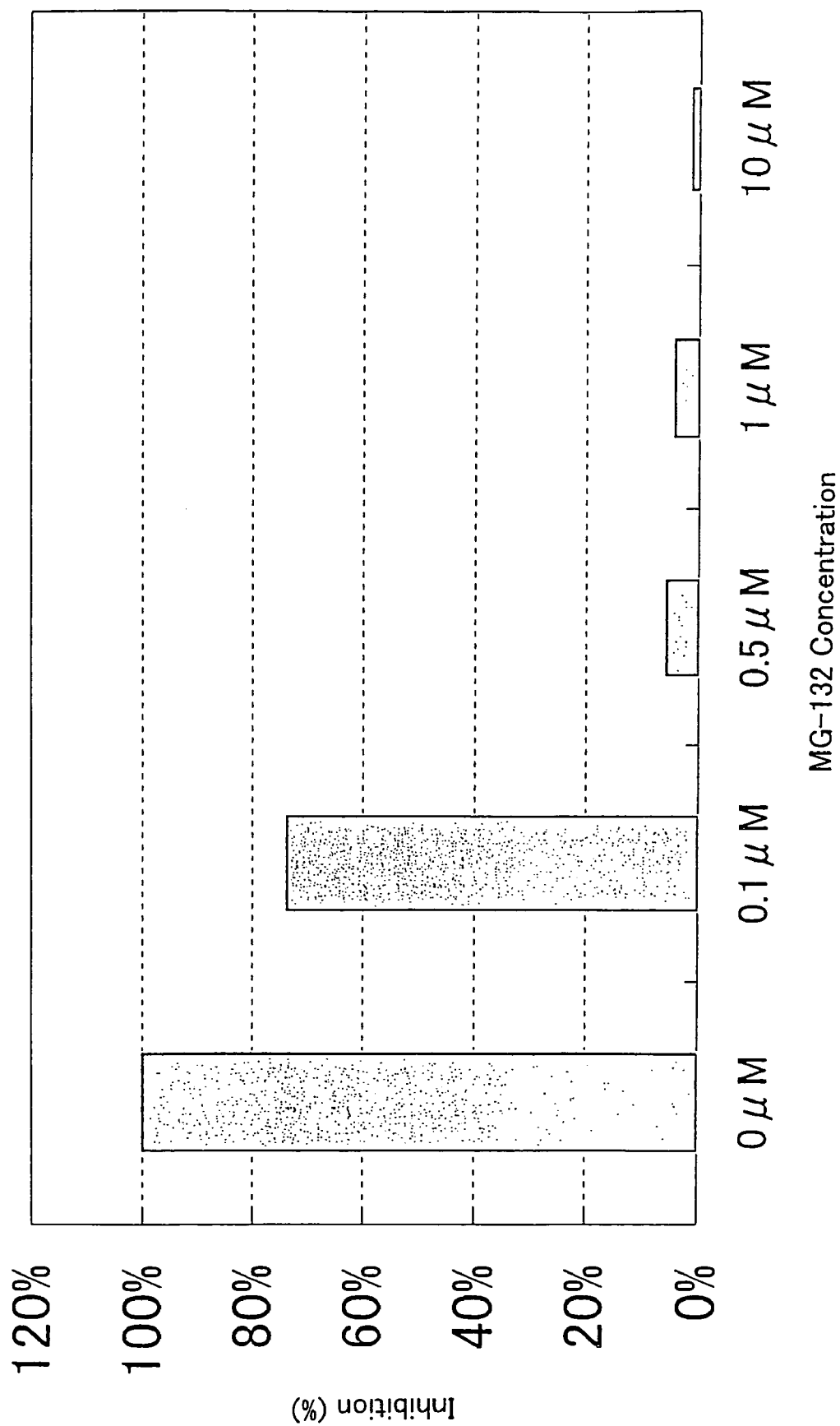
FIG. 14 is a graph showing NF-κB reporter activity inhibition by the proteasome inhibitor MG-132 (SEQ ID NO: 81) in Example 3.
Figure 15:
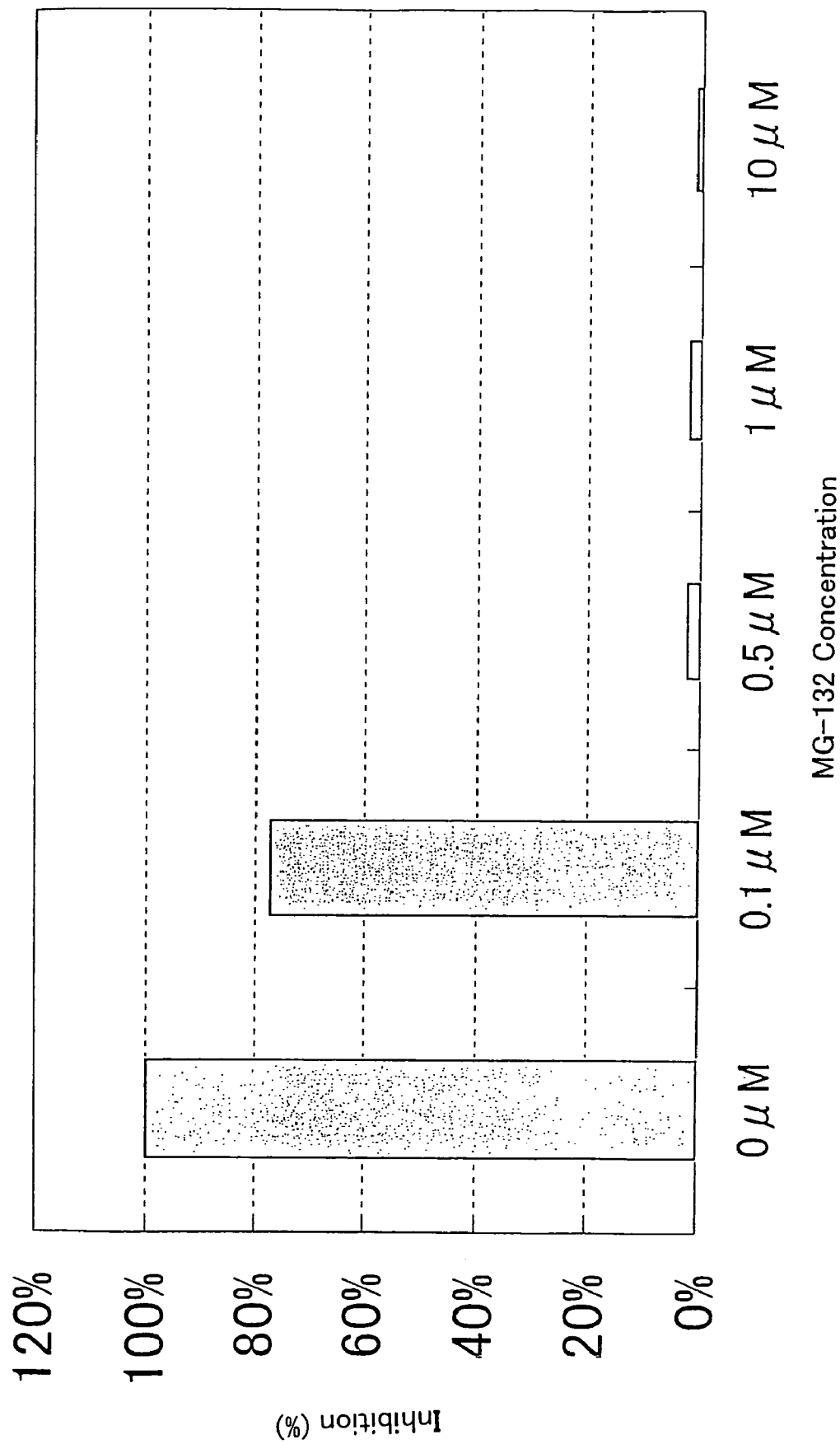
FIG. 15 is a graph showing NF-κB reporter activity inhibition by the proteasome inhibitor MG-132 (SEQ ID NO: 87) in Example 3.
Figure 16:
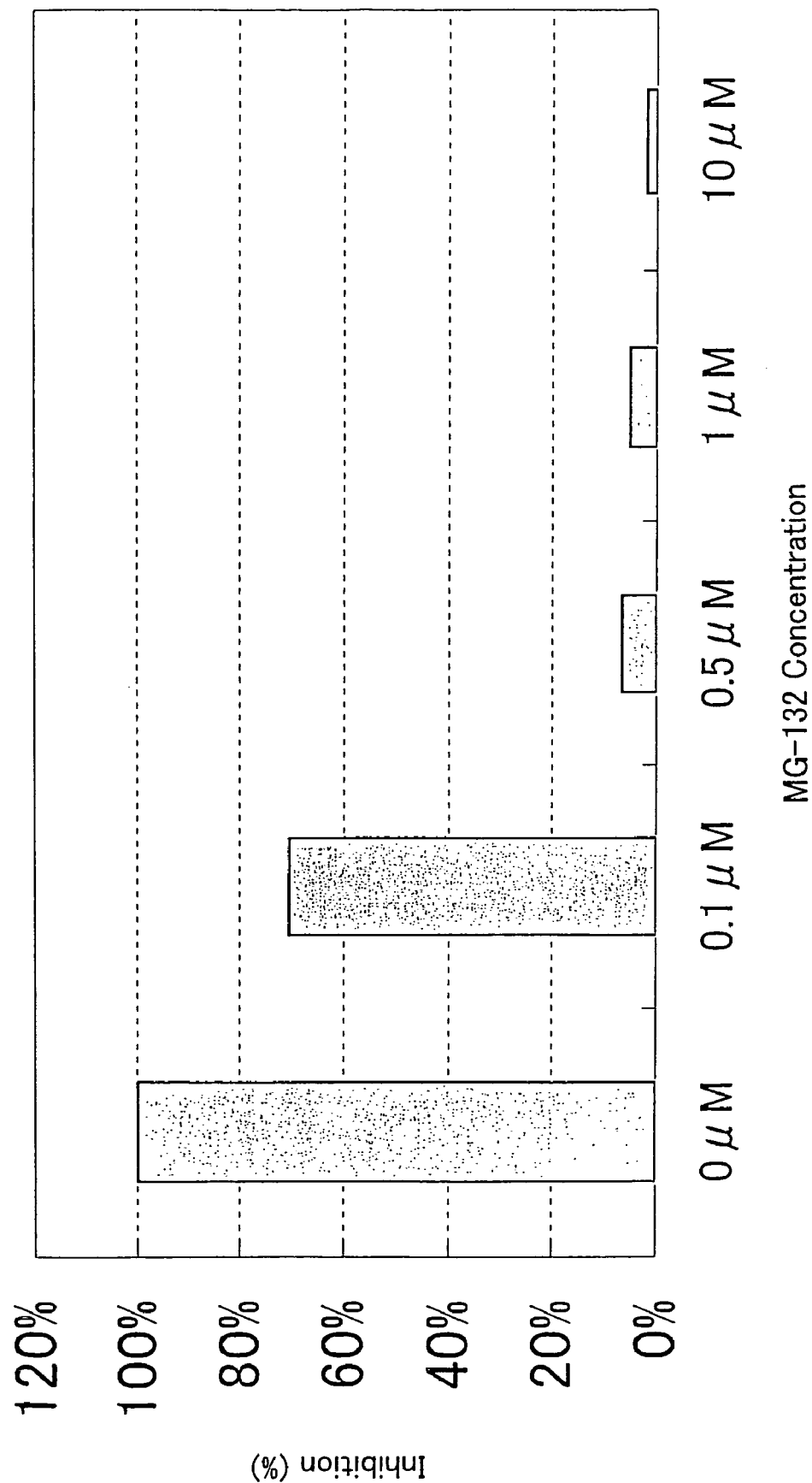
FIG. 16 is a graph showing NF-κB reporter activity inhibition by the proteasome inhibitor MG-132 (SEQ ID NO: 91) in Example 3.
Figure 17:
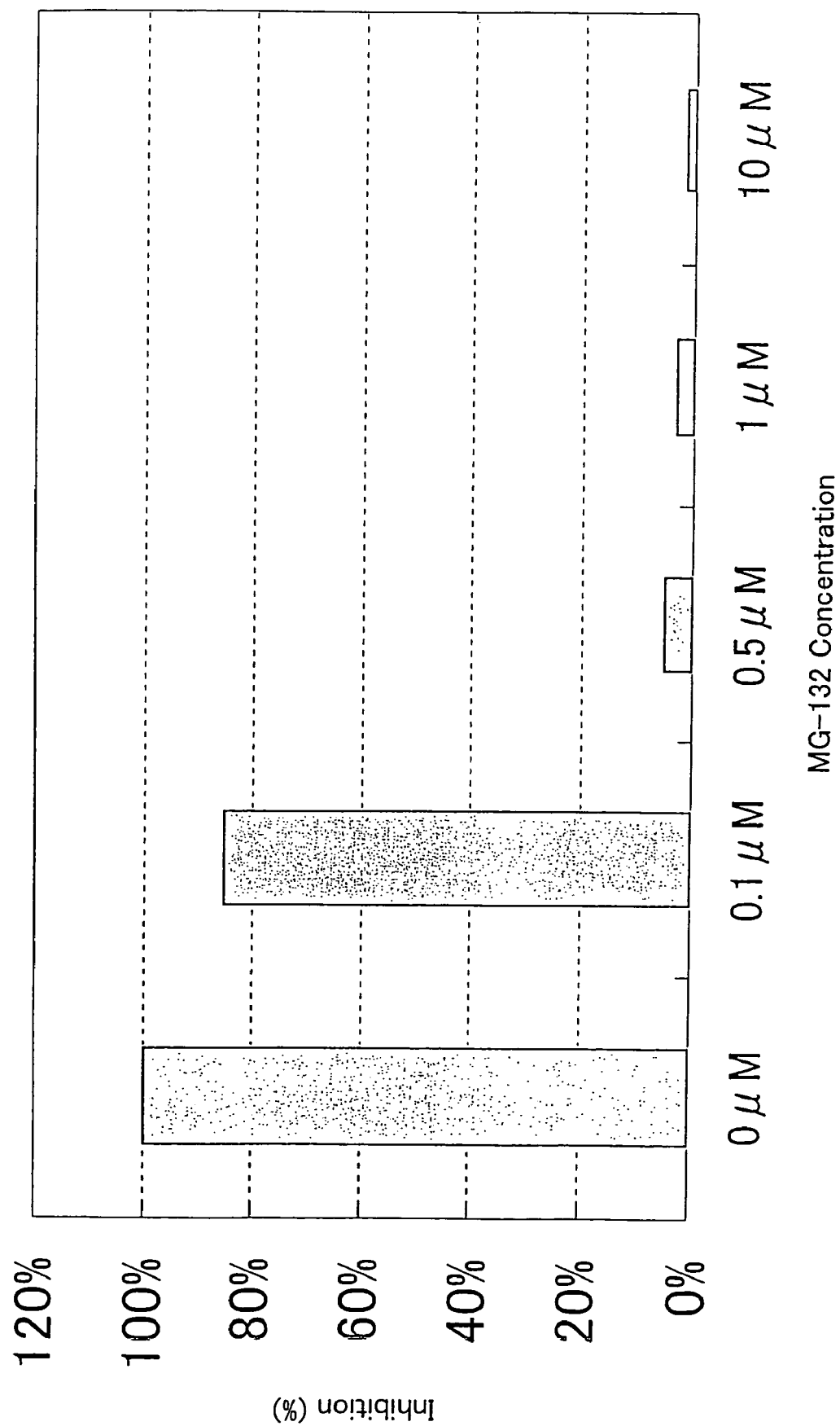
FIG. 17 is a graph showing NF-κB reporter activity inhibition by the proteasome inhibitor MG-132 (SEQ ID NO: 93) in Example 3.
Figure 18:
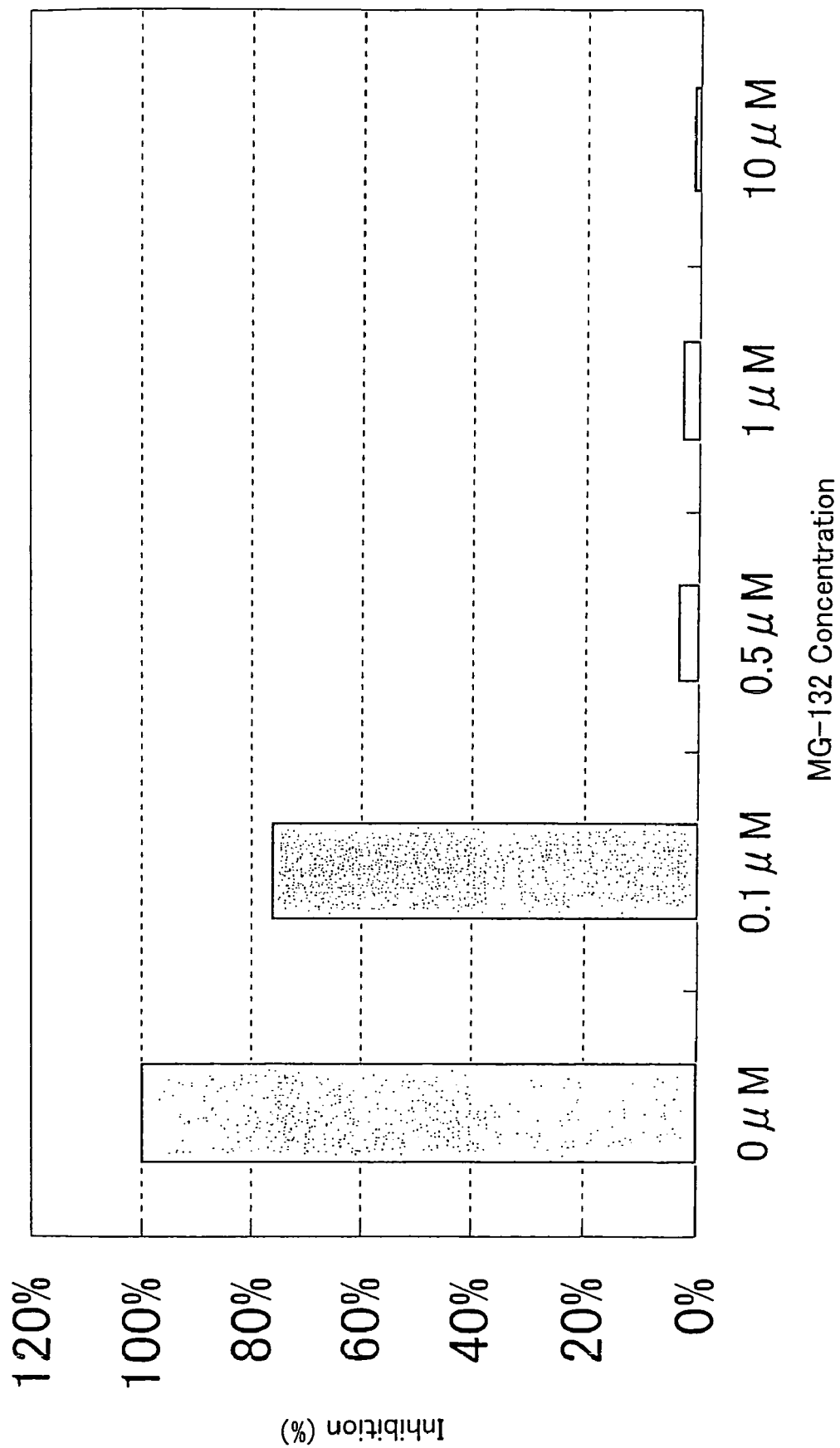
FIG. 18 is a graph showing NF-κB reporter activity inhibition by the proteasome inhibitor MG-132 (SEQ ID NO: 97) in Example 3.
Figure 19:
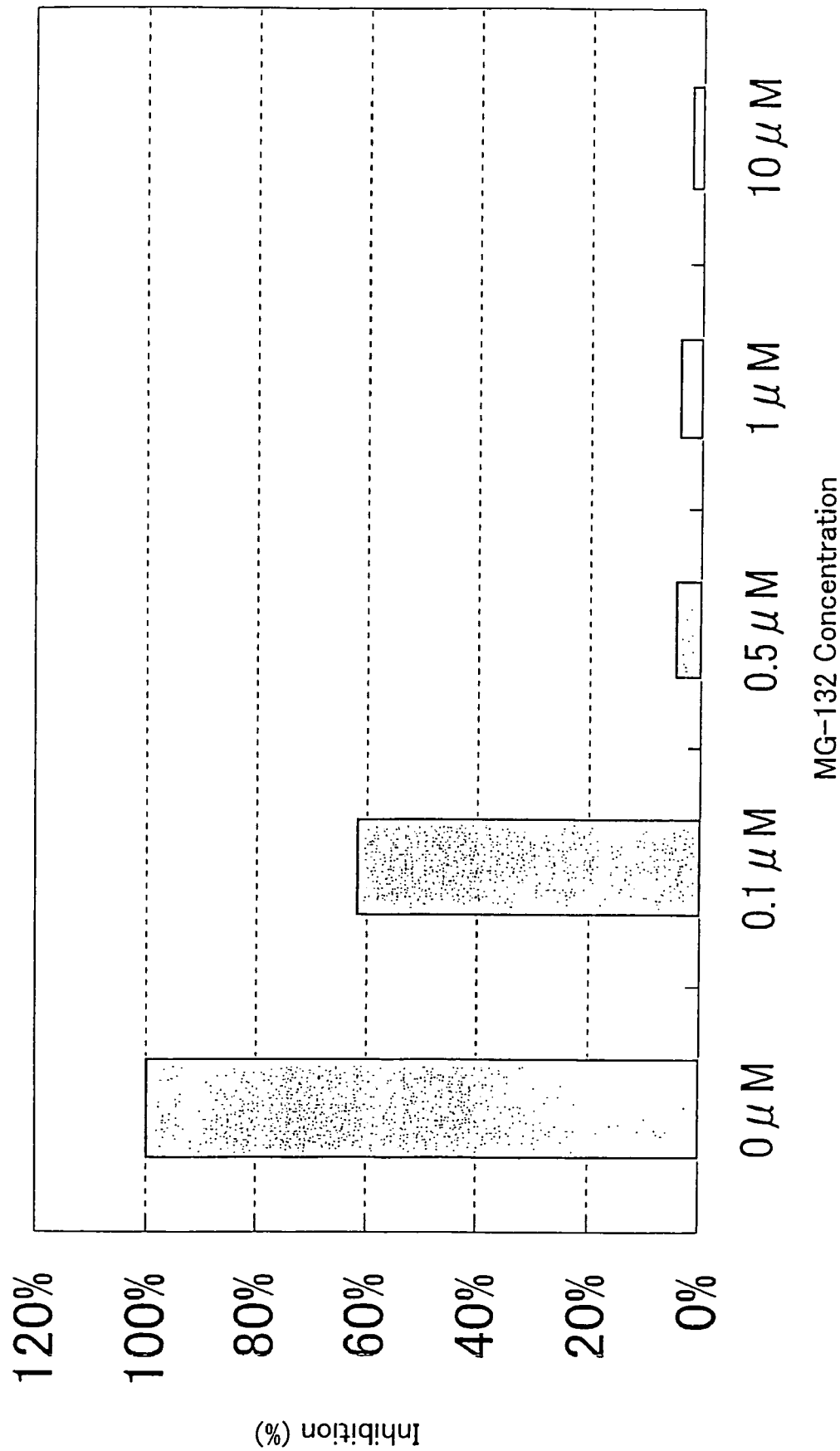
FIG. 19 is a graph showing NF-κB reporter activity inhibition by the proteasome inhibitor MG-132 (SEQ ID NO: 121) in Example 3.
Figure 20:
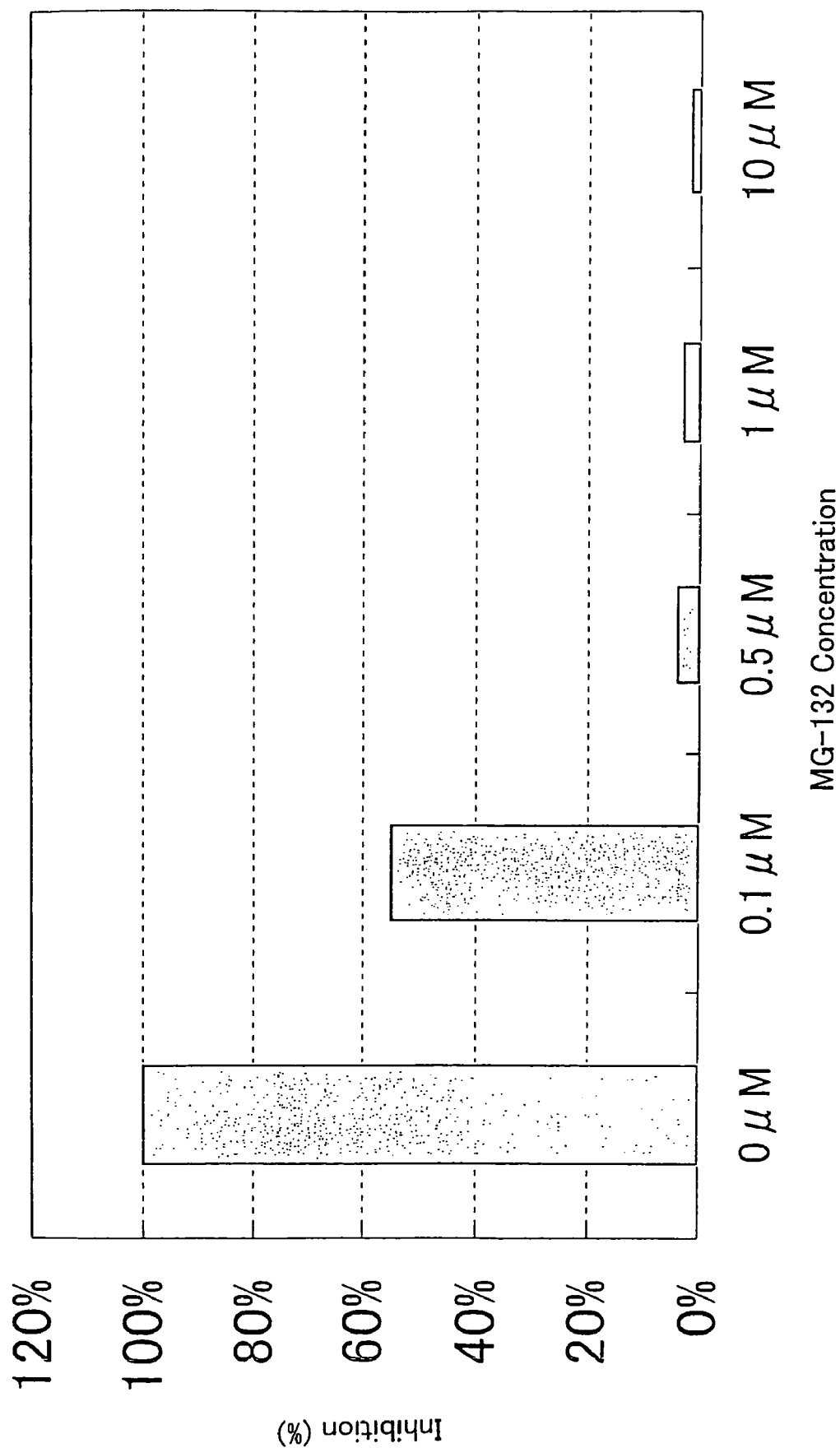
FIG. 20 is a graph showing NF-κB reporter activity inhibition by the proteasome inhibitor MG-132 (SEQ ID NO: 123) in Example 3.
Figure 21:
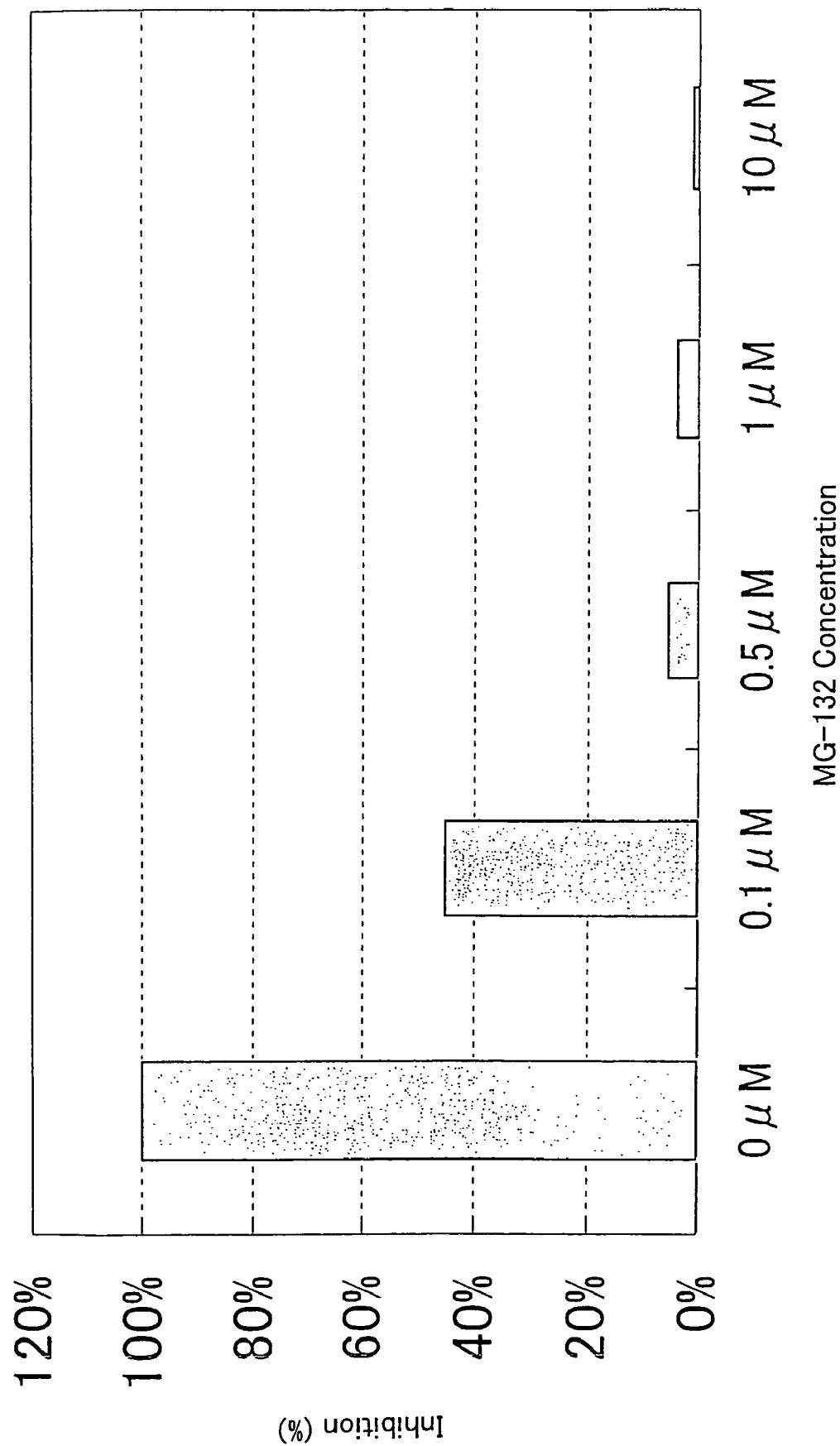
FIG. 21 is a graph showing NF-κB reporter activity inhibition by the proteasome inhibitor MG-132 (SEQ ID NO: 129) in Example 3.
Figure 22:
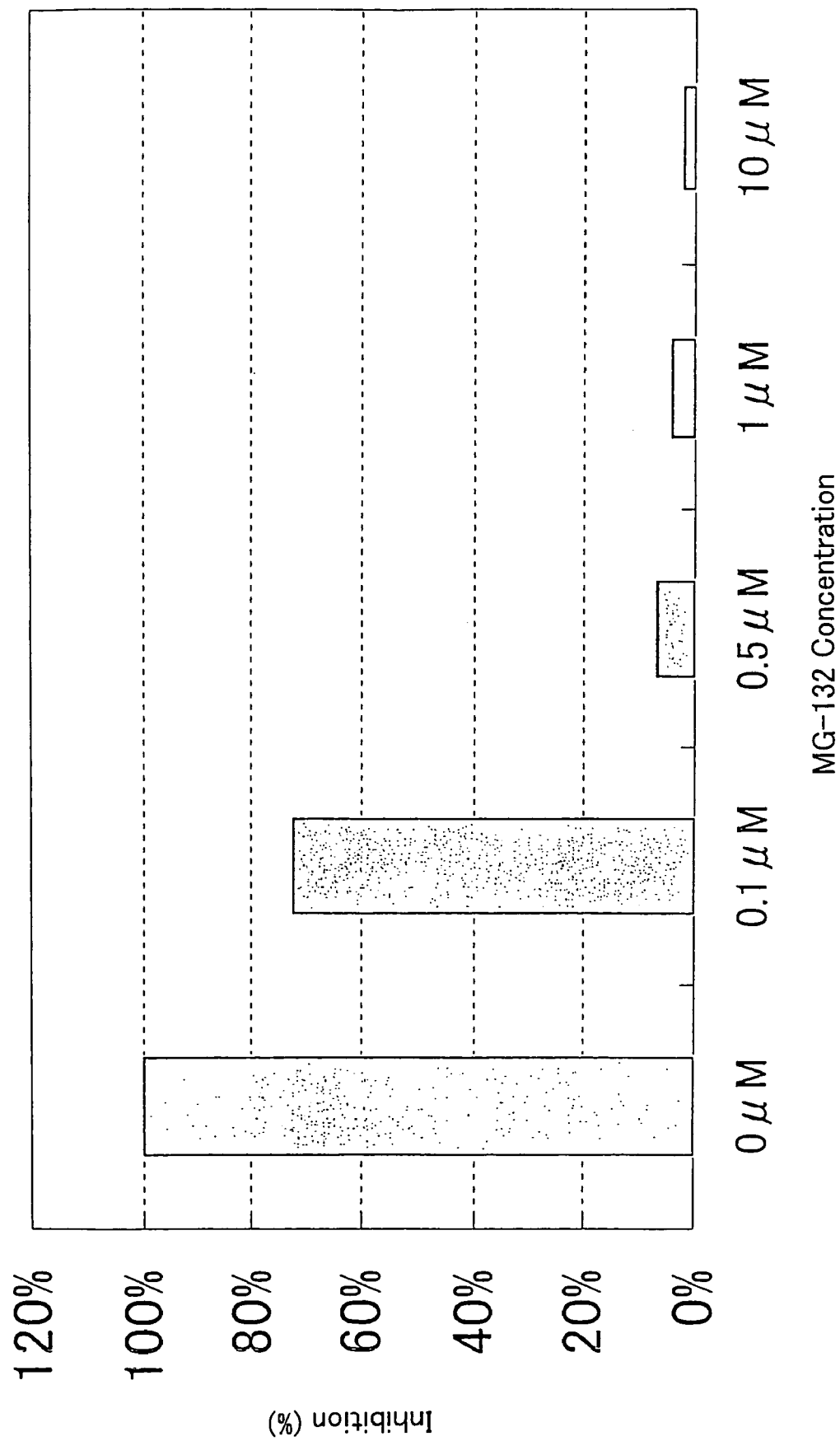
FIG. 22 is a graph showing NF-κB reporter activity inhibition by the proteasome inhibitor MG-132 (SEQ ID NO: 154) in Example 3.
Figure 23:
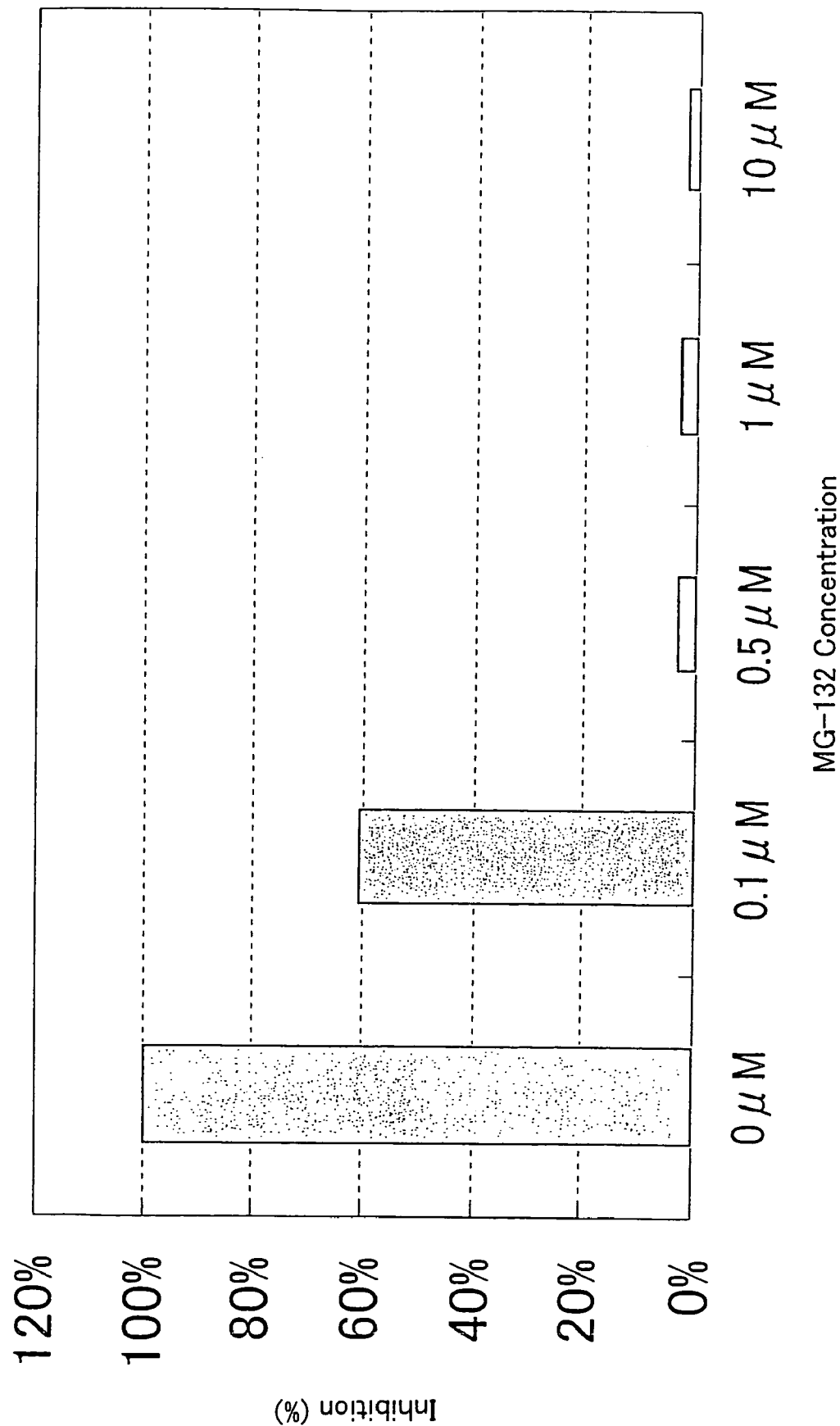
FIG. 23 is a graph showing NF-κB reporter activity inhibition by the proteasome inhibitor MG-132 (SEQ ID NO: 158) in Example 3.
Figure 24:
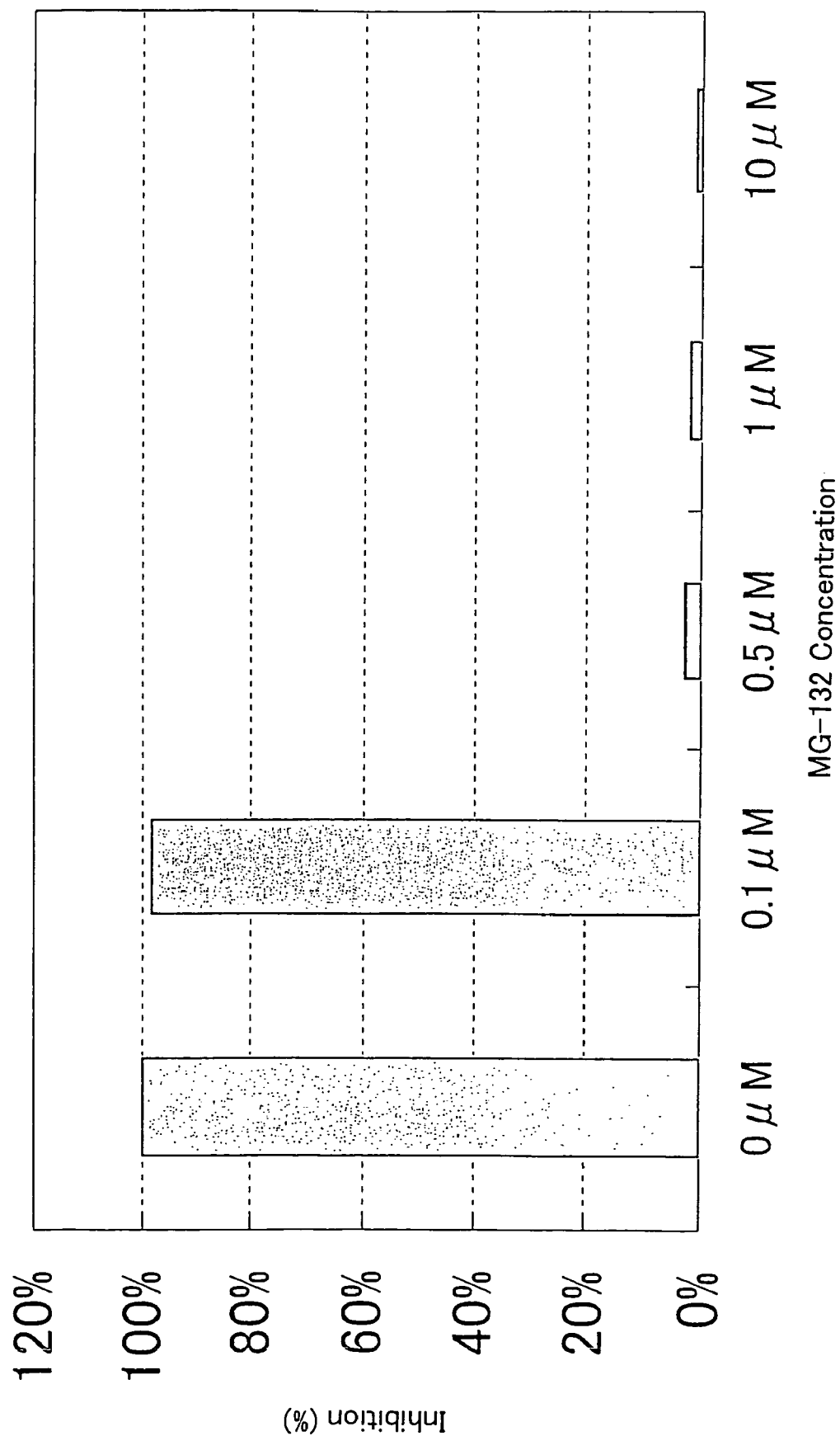
FIG. 24 is a graph showing NF-κB reporter activity inhibition by the proteasome inhibitor MG-132 (SEQ ID NO: 162) in Example 3.
Figure 25:
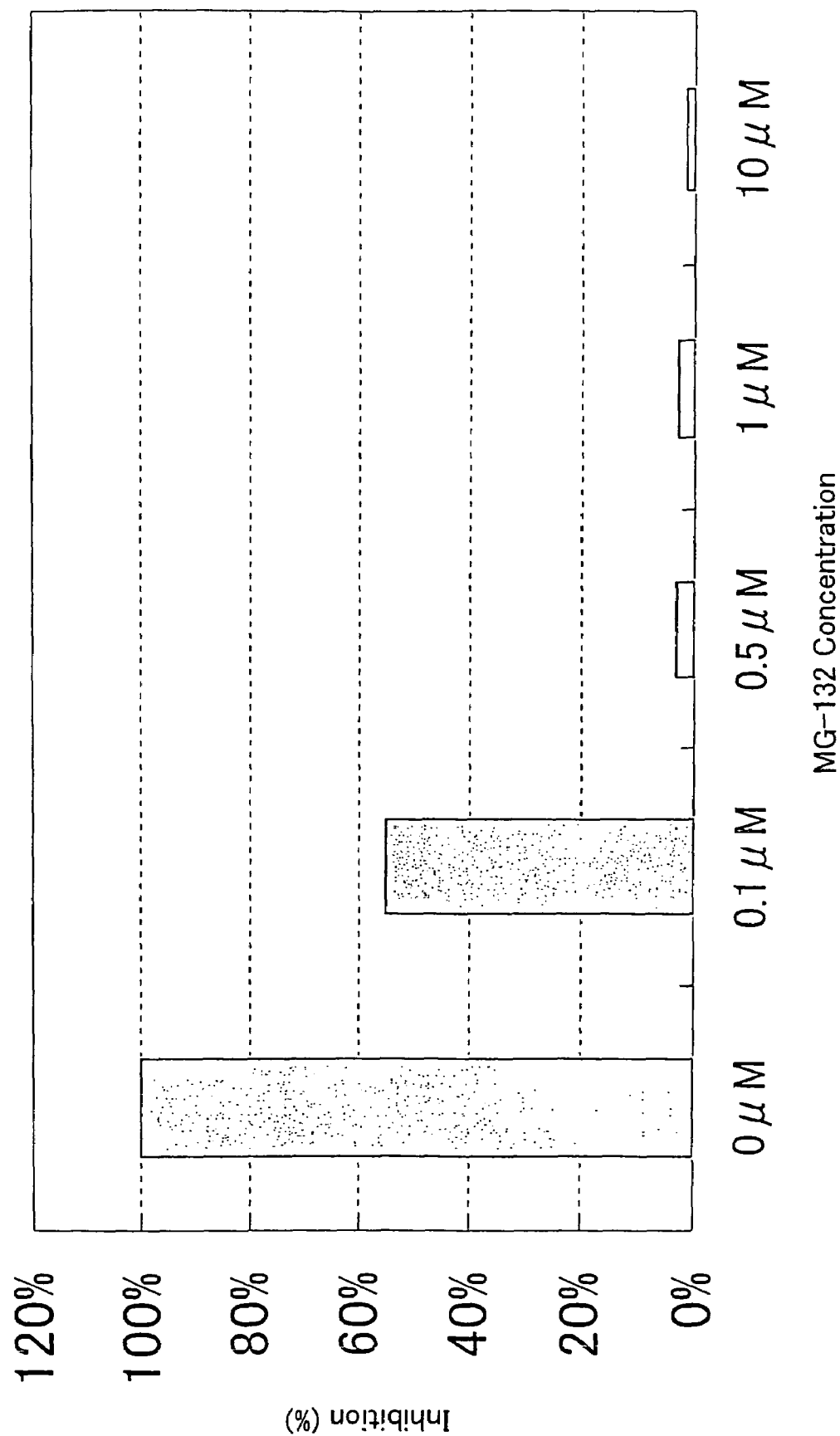
FIG. 25 is a graph showing NF-κB reporter activity inhibition by the proteasome inhibitor MG-132 (SEQ ID NO: 168) in Example 3.
Figure 26:
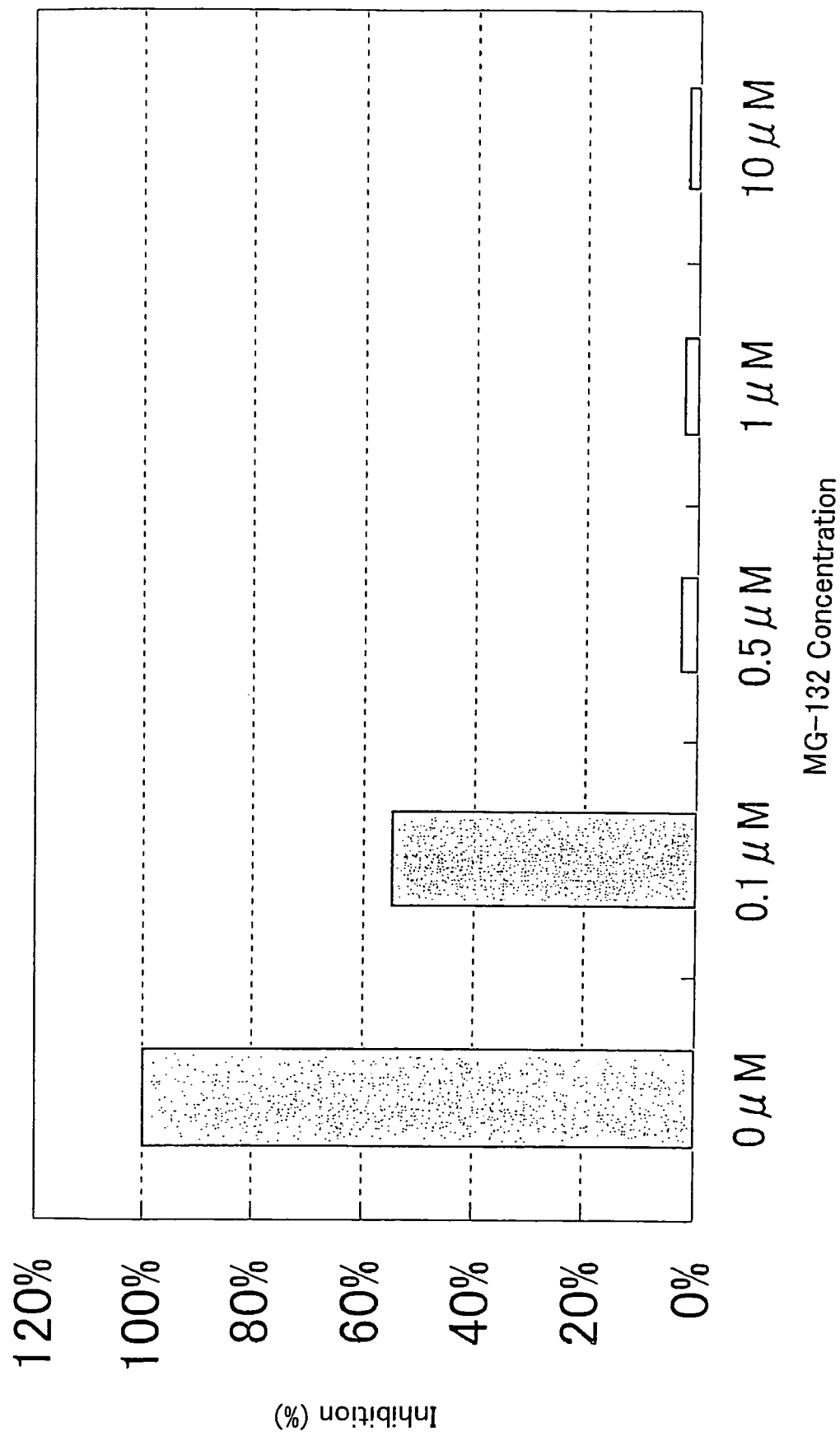
FIG. 26 is a graph showing NF-κB reporter activity inhibition by the proteasome inhibitor MG-132 (SEQ ID NO: 170) in Example 3.
Figure 27:
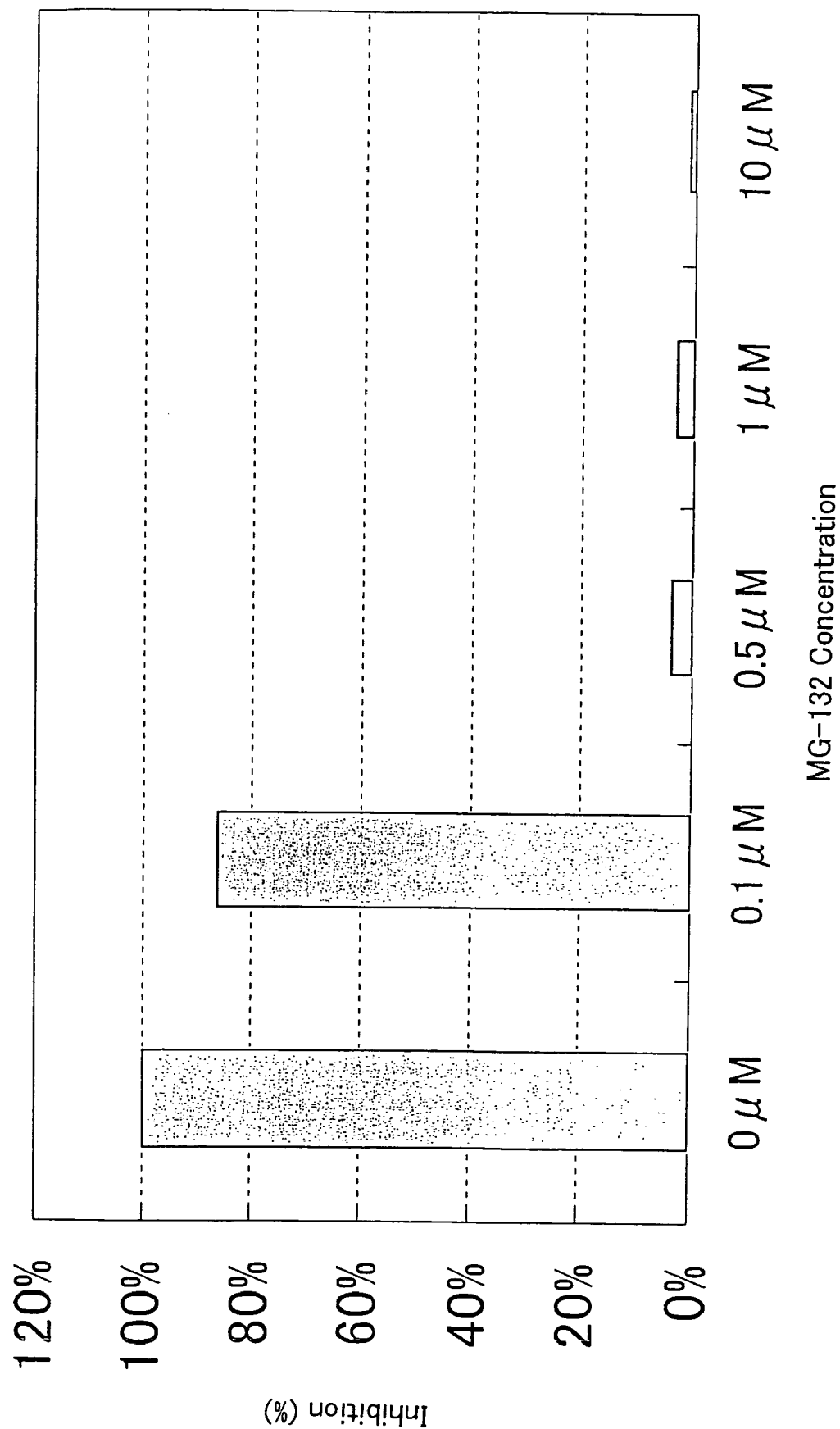
FIG. 27 is a graph showing NF-κB reporter activity inhibition by the proteasome inhibitor MG-132 (SEQ ID NO: 172) in Example 3.
Figure 28:
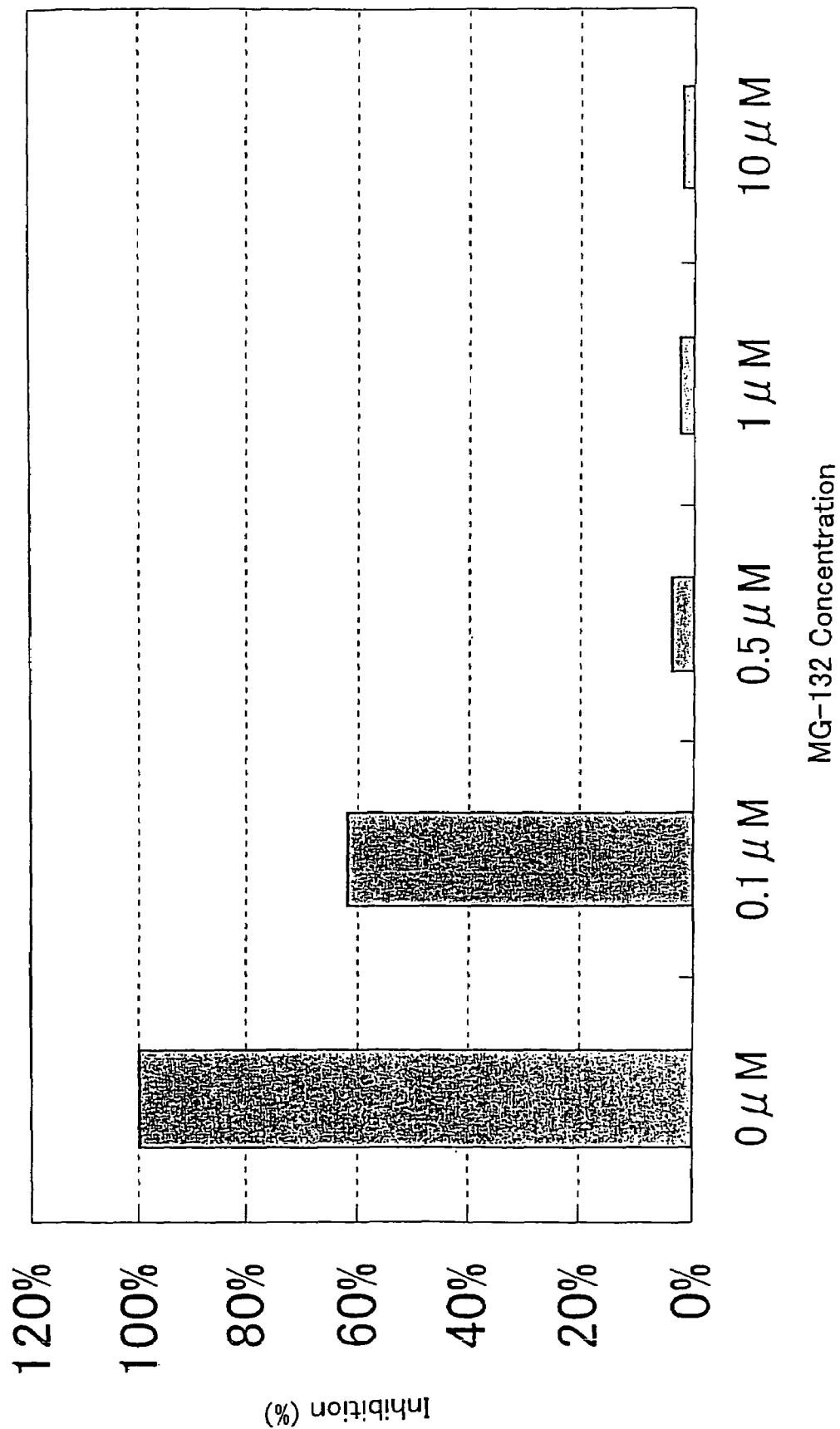
FIG. 28 is a graph showing NF-κB reporter activity inhibition by the proteasome inhibitor MG-132 (SEQ ID NO: 176) in Example 3.
Figure 29:
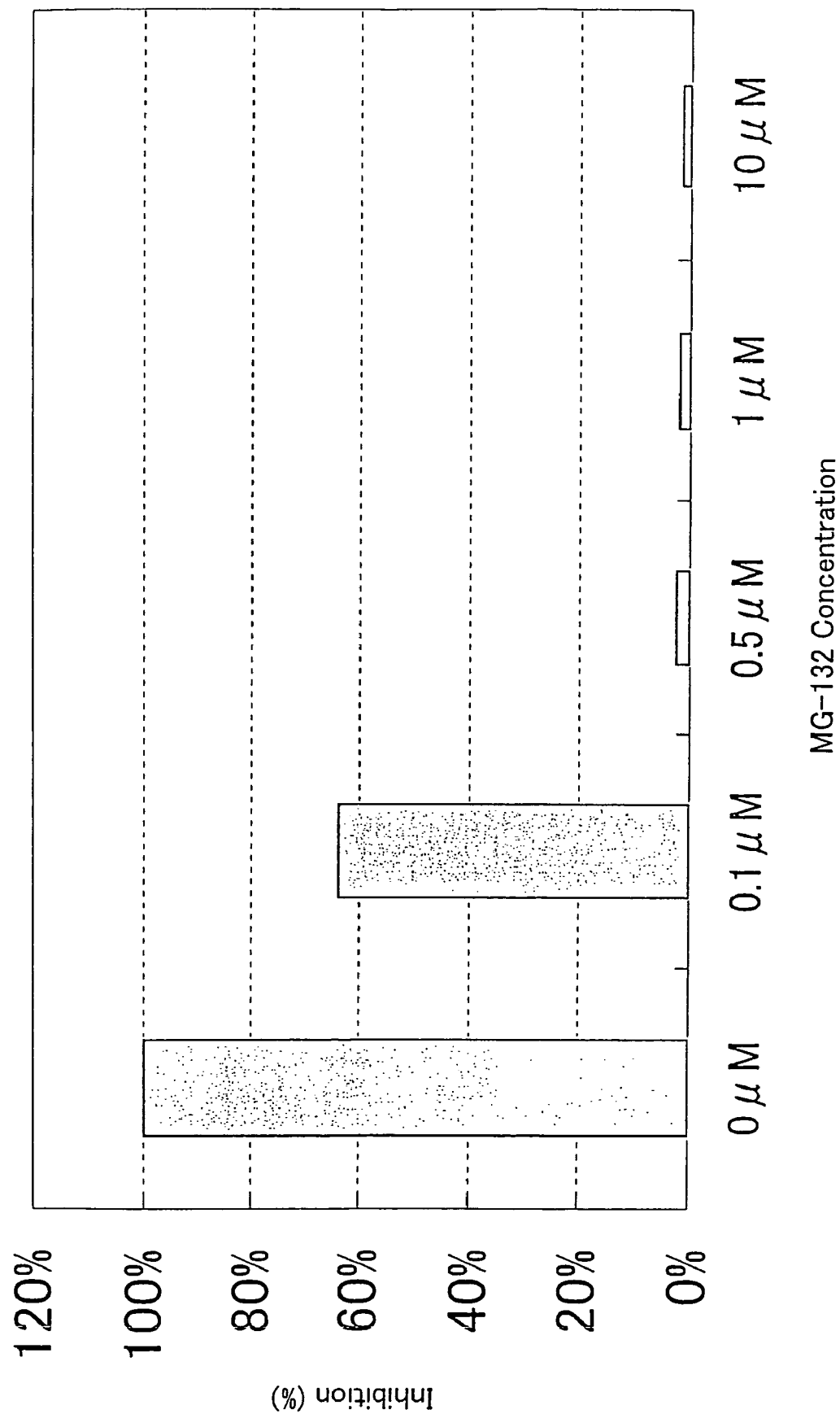
FIG. 29 is a graph showing NF-κB reporter activity inhibition by the proteasome inhibitor MG-132 (SEQ ID NO: 178) in Example 3.

293-EBNA cells were seeded on 5% FBS containing DMEM medium in a 96-well cell culture plate to a final cell density of 1×104 cells/100 µl/well, and cultured for 24 hours at 37° C. in the presence of 5% CO2. Then, 50 ng of the expression vector comprising the gene encoding NF-κB activating protein of SEQ ID NO: 5, 9, 17, 21, 35, 37, 41, 53, 57, 63, 67, 71, 75, 81, 87, 91, 93, 97, 121, 123, 129, 154, 158, 162, 168, 170, 172, 176 or 178, and 50 ng of the reporter plasmid pNF κB-Luc were cotransfected into the cells in a well using FuGENE 6. After 1 hour, the proteasome inhibitor MG-132 (purchased form CALBIOCHEM) (Uehara T. et al., J. Biol. Chem. 274, p. 15875-15882 (1999); Wang X. C. et al., Invest. Ophathalmol. Vis. Sci. 40, p. 477-486) was added to the culture to final concentrations of 0.1 µM, 0.5 µM, 1.0 µM and 10 µM, respectively. After 24 hours of culture at 37° C., the reporter activity was measured using PIKKA GENE LT2.0. The results showed that MG132 inhibited the expression of the reporter gene (FIG. 1 to FIG. 29).

Example 4

Intracellular Localization (1) Preparation of Expression Vector pDEST-NGFP for Adding GFP to the N-Terminus of the Target Protein After cleaving pQBI25-fC1 (purchased from Wako Pure Chemical Industries, Ltd.) with restriction enzyme Apa I, the ends thereof were blunted with a DNA Blunting Kit (manufactured by Takara Bio Inc.) and blunted fragment was then linked with rfC cassette of Gateway Vector Conversion System (Invitrogen) with T4 DNA ligase to prepare pDEST-NGFP.

(2) Preparation of Expression Vector pDEST-CGFP for Adding GFP to the C-Terminus of the Target Protein After cleaving pQBI25-fA1 (purchased from Wako Pure Chemical Industries, Ltd.) with restriction enzyme Bgl II, the ends thereof were blunted with a DNA Blunting Kit (manufactured by Takara Bio Inc.) and blunted fragments were subjected to self-ligation. After transforming E. coli DH5 strain, plasmids were prepared by standard methods. Next, the plasmid was cleaved with restriction enzymes Nru I and Sac II, and after blunting the ends thereof, the fragment was linked to rfB cassette of Gateway Vector Conversion System (Invitrogen) to prepare pDEST-CGFP.

(3) Intracellular Localization of the Protein (SEQ ID NO: 5) Encoded by the Polynucleotide of SEQ ID NO: 6.

Using the expression vectors prepared in (1) and (2) above, pDEST-NGFP and pDEST-CGFP, expression vectors, pDEST-NGFP 5 and pDEST-CGFP 5, for expressing a fusion protein of the protein (SEQ ID NO: 5) encoded by the polynucleotide of SEQ ID NO: 6 and GFP, were respectively prepared. Preparation of expression vectors was performed with Gateway Technology (Invitrogen), in accordance with their recommended protocol.

Africa Green Monkey kidney-derived Vero cells (obtained from ATCC) were inoculated on Opti-MEM medium (Invitrogen) containing 5% FBS in a 96-well EZView culture plate (manufactured by Asahi Technoglass Corporation) to a cell density of 5000 cells/100 μl/well, and cultured for 24 hours at 37° C. in the presence of 5% CO2. Next, using FuGENE6, 100 ng of the expression vector pDEST-NGFP5, or pDEST-CGFP5, was added to 1 well. After culturing for 24 or 48 hours at 37° C., cells were observed with a fluorescence microscope. For observation with a fluorescence microscope, IX70 manufactured by Olympus was used, and observation was performed with the NIBA filter set of the microscope. Results showed localization of the protein of SEQ ID NO: 5 primarily in endoplasmic reticulum.

(4) Intracellular Localization of the Protein (SEQ ID NO: 87) Encoded by the Polynucleotide of SEQ ID NO: 88.

Using the expression vector pDEST-CGFP prepared in (2) above, an expression vector, pDEST-CGFP87, for expressing a fusion protein of the protein (SEQ ID NO: 87) encoded by the polynucleotide of SEQ ID NO: 88, and GFP, was prepared. Preparation of the expression vector was performed with Gateway Technology (Invitrogen), in accordance with their recommended protocol.

Africa green monkey kidney-derived Vero cells (obtained from ATCC) were inoculated on Opti-MEM medium (Invitrogen) containing 5% FBS in a 96-well EZView culture plate (manufactured by Asahi Technoglass Corporation) to a cell density of 5000 cells/100 μl/well, and cultured for 24 hours at 37° C. in the presence of 5% CO2. Then using FuGENE6, 100 ng of the expression vector pDEST-CGFP87 was added to 1 well. After culturing for 24 or 48 hours at 37° C., cells were observed with a fluorescence microscope. For observation with a fluorescence microscope, IX70 manufactured by Olympus was used, and observation was performed with the NIBA filter set of the microscope. Results showed localization of the protein of SEQ ID NO: 87 in cell membrane.

Example 5

Induction of Expression of Human Interferon (IFN)-β by Using the Protein (SEQ ID NO: 154) Encoded by the Polynucleotide of SEQ ID NO: 153

EBNA cells (Invitrogen) were inoculated on DMEM medium containing 5% FBS in a 96-well cell culture plate to a cell density of 1.2×104 cells/100 μl/well, and cultured for 24 hours at 37° C. in the presence of 5% CO2. Then using FuGENE6, 20 ng of the expression vector having the nucleotide sequence of SEQ ID NO: 153 and 50 ng of a reporter plasmid having human interferon (IFN)-β gene promoter were added to 1 well. After 24 hours of culture at 37° C., the reporter activity (luciferase activity) was measured using PicaGene LT2.0. Results indicated that cells into which the expression vector having the nucleotide sequence of SEQ ID NO: 153 was introduced had luciferase activity 100 or more times greater than cells of a control experiment (luciferase activity of cells into which null vector pME18S-FL3 was introduced).

It should be noted that the reporter plasmid having human IFN-β gene promoter was prepared in the following method. Primers of two synthetic oligonucleotides:

```
                                          (SEQ ID NO: 183)
5'-CTAGCTAGCTAGAAACTACTAAAATGTAAATGACATAG-3'
and
                                          (SEQ ID NO: 184)
5'-CGCAAGCTTGAAAGGTTGCAGTTAGAATGTCCTTTC-3',
``` were designed, and using this primer pair, PCR was performed using human genome (CLONTECH) as a template. An amplified fragment of approx. 0.15 kb was isolated, and after digesting with NheI and HindIII restriction enzymes, the fragment was inserted between the NheI site and HindIII site of firefly luciferase reporter vector pGL3-Basic Vector (Promega Corporation) using T4 DNA ligase to prepare the reporter plasmid. PCR was performed by preparing 50 μl of reaction solution containing 1 μl of KOD-Plus-(TOYOBO), 5 μl of 10×PCR Buffer (supplied with KOD-Plus-), 5 μl of 2 mM dNTPs (supplied with KOD-Plus-), 2 μl of 25 mM MgSO4 (supplied with KOD-Plus-), 1.5 μl of each of the above primers (each at a concentration of 10 μM) and 100 ng of human Genomic DNA (CLONTECH) and after 2 minutes incubation at 94° C., conducting 45 cycles of incubation for 15 seconds at 94° C., 30 seconds at 60° C., and 40 seconds at 68° C. using Takara PCR Thermal Cycler MP (manufactured by Takara Bio Inc.).

Example 6

Inhibition of Expression of the Gene of SEQ ID NO:88 by Double Stranded Nucleic Acid (1) Preparation of Double Stranded Nucleic Acid First, oligonucleotides having the nucleotide sequences described below were prepared by ordinary chemical synthesis. It should be noted that in the sequences described below, A, G, C and U represent each ribonucleotide, and T represents deoxyribonucleotide.

```
                                          (SEQ ID NO: 185)
    A1 5'-GUCCAGGAUAUCAUGAGUCTT-3'

(SEQ ID NO: 186)
    B1 5'-GACUCAUGAUAUCCUGGACTT-3'

(SEQ ID NO: 187)
    A2 5'-GAAGUCUGAAGAUCUAUCCTT-3'

(SEQ ID NO: 188)
    B2 5'-GGAUAGAUCUUCAGACUUCTT-3'

(SEQ ID NO: 189)
    A3 5'-GCUGAAGAAGAGGUGUUCCTT-3'

(SEQ ID NO: 190)
    B3 5'-GGAACACCUCUUCUUCAGCTT-3'

(SEQ ID NO: 191)
    A4 5'-GAUGACACAGAUGAAGCCCTT-3'

(SEQ ID NO: 192)
    B4 5'-GGGCUUCAUCUGUGUCAUCTT-3'

(SEQ ID NO: 193)
    A5 5'-GCCCUCAGAGUCCAGAAUCTT-3'

(SEQ ID NO: 194)
    B5 5'-GAUUCUGGACUCUGAGGGCTT-3'
```

-continued

```
                                      (SEQ ID NO: 195)
A6  5'-GAUGACUUUGGUAUCAAACTT-3'

(SEQ ID NO: 196)
B6  5'-GUUUGAUACCAAAGUCAUCTT-3'
```

Next, the oligonucleotides were each dissolved in RNase-free water to a concentration of 50 μM (50 pmol/μl). Then, 30 μl each of the dissolved oligonucleotides A1 and B1, and 15 μl of 5× annealing buffer (500 mM potassium acetate, 150 mM HEPES-KOH pH 7.4, 10 mM magnesium acetate) were mixed (total: 75 μl). After heating the solution for 1 minute at 90° C., the solution was incubated for 60 minutes at 37° C., and the two oligonucleotides were annealed to prepare a double stranded nucleic acid. The double stranded nucleic acid was designated 88-1.

By the same method as described above, the oligonucleotides A2 and B2 were annealed to prepare double stranded nucleic acid 88-2.

By the same method as described above, the oligonucleotides A3 and B3 were annealed to prepare double stranded nucleic acid 88-3.

By the same method as described above, the oligonucleotides A4 and B4 were annealed to prepare double stranded nucleic acid 88-4.

By the same method as described above, the oligonucleotides A5 and B5 were annealed to prepare double stranded nucleic acid 88-5.

By the same method as described above, the oligonucleotides A6 and B6 were annealed to prepare double stranded nucleic acid 88-6.

(2) Expression Inhibition of the Gene of SEQ ID NO:88 by Double Stranded Nucleic Acid Prepared in (1) Above EBNA cells (Invitrogen) were inoculated on DMEM medium containing 5% FBS in a 96-well cell culture plate to a cell density of 1.2×10⁴ cells/100 μl/well, and cultured for 24 hours at 37° C. in the presence of 5% CO2. Next, using Lipofectamine 2000 (Invitrogen), 50 ng of an expression vector having the polynucleotide of SEQ ID NO:88 and 50 ng of pNFkB-Luc (STRATAGENE) and 10 ng of phRL-TK vector (Promega Corporation) used as an internal standard, were co-transfected with double stranded nucleic acid 88-1 (10 pmol) prepared in (1) above into 1 well. After culturing for 24 hours at 37° C., firefly luciferase activity and *Renilla reniformis* luciferase activity were measured using a Dual-Luciferase Reporter Assay System (Promega Corporation). Further, each of 88-2 (10 pmol), 88-3 (10 pmol), 88-4 (10 pmol), 88-5 (10 pmol) or 88-6 (10 pmol) was co-transfected into 1 well in place of 88-1 (10 pmol), and luciferase activity was measured in the same manner. Results are shown in Table 1. In Table 1, values for activity represent relative values when firefly luciferase activity in the control experiment (cells into which double stranded nucleic acid has not been introduced) is established as 100%. (It should be noted that values for firefly luciferase activity were standardized with values for *Renilla reniformis* luciferase activity used as an internal standard, before using these values in calculations.)

As shown in Table 1, cells into which double stranded nucleic acid 88-1, 88-2, 88-3, 88-4, 88-5 or 88-6 has been introduced exhibited inhibition of firefly luciferase activity relative to the control experiment (cells into which double stranded nucleic acid has not been introduced). These results indicated that double stranded nucleic acids 88-1, 88-2, 88-3, 88-4, 88-5 and 88-6 inhibited expression of the gene of SEQ ID NO: 88.

TABLE 1

| double stranded nucleic acid | relative luciferase activity (%) |
|---|---|
| 88-1 | 18 |
| 88-2 | 12 |
| 88-3 | 9 |
| 88-4 | 8 |
| 88-5 | 5 |
| 88-6 | 7 |

Example 7

Expression Inhibition of the Gene of SEQ ID NO: 88 Using siRNA Expression Vector (1) Preparation of siRNA Expression Vector pUH1

Expression vector pUH1, which is used in the preparation of expression vectors for expression of siRNA in animal cells, was prepared as follows.

First, in order to clone a promoter fragment of human U6 small nuclear RNA (GenBank Accession Number: M14486) gene, the following two oligonucleotides primers:

```
                                      (SEQ ID NO: 209)
5'-GCGAATTCGGGCAGGAAGAGGGCCTATTTCCCAT-3',
and (SEQ ID NO: 210)
5'-GCAAGCTTTTTTTGTCTTCTTTCCACAAGATATATAAAGCCAAG-3'
``` were synthesized, and using this primer pair, PCR was performed with human genome (CLONTECH) as a template. An amplified fragment of approx. 0.27 kb was isolated, and after digestion with restriction enzymes EcoRI and HindIII, the fragment was inserted between EcoRI and HindIII sites of pBluescript II KS(+) (STRATAGENE) using T4 DNA ligase. Thereafter, *E. coli* DH5 (TOYOBO) was transformed and the target plasmid was obtained (and designated pU1).

Then, in order to clone a promoter fragment of human H1 RNA (GenBank Accession Number: X16612) gene, the following two oligonucleotide primers:

```
                                      (SEQ ID NO: 211)
5'-CGCTCGAGCCATGGAATTCGAACGCTGACGTC-3',
and (SEQ ID NO: 212)
5'-GCAAGCTTTCTCATACAGAACTTATAAGATTCCC-3'
``` were synthesized, and using this primer pair, PCR was performed with human genome (CLONTECH) as a template. An amplified fragment of approx. 0.24 kb was isolated, and after digestion with restriction enzymes XhoI and HindIII, the fragment was inserted between XhoI and HindIII sites of plasmid pU1 prepared above using T4 DNA ligase. Thereafter, *E. coli* DH5 (TOYOBO) was transformed with the plasmid to prepare an expression vector pUH1.

In the above, PCR was performed by preparing 50 μl of reaction solution comprising 1 μl of KOD-Plus-(TOYOBO Co. Ltd.), 5 μl of 10×PCR Buffer (supplied with KOD-Plus-), 5 μl of 2 mM dNTPs (supplied with KOD-Plus-), 2 μl of 25 mM MgSO4 (supplied with KOD-Plus-), 1.5 μl of each of the above primers (each at a concentration of 10 μM) and 100 ng of human Genomic DNA (CLONTECH), and after 2 minutes incubation at 94° C., conducting 45 cycles of incubation for 15 seconds at 94° C., 30 seconds at 60° C., and 40 seconds at 68° C. using Takara PCR Thermal Cycler MP (manufactured by Takara Bio Inc.), to thereby obtain each fragment.

(2) Preparation of siRNA Expression Vectors Targeting the Gene of SEQ ID NO: 88

The synthetic oligonucleotides (DNA) of SEQ ID NO: 197 and SEQ ID NO: 198 were dissolved to a final concentration of 10 μM in an annealing buffer (100 mM potassium acetate, 30 mM HEPES-KOH pH 7.4, 2 mM magnesium acetate), and after heating the solution for 4 minutes at 94° C., the solution was incubated for 1 hour at 37° C. to effect annealing. The obtained double stranded oligonucleotide was inserted between BbsI and HindIII sites of the expression vector pUH1 using T4 DNA ligase. Thereafter, *E. coli* DH5 (TOYOBO) was transformed with the resultant vector, and the siRNA expression vector was purified using QIAfilter Plasmid Kit (QIAGEN). The siRNA expression vector was given the designation pUH88-1.

siRNA expression vector pUH88-2 was prepared from the synthetic oligonucleotides of SEQ ID NO: 199 and SEQ ID NO: 200, by the same method as described above.

siRNA expression vector pUH88-3 was prepared from the synthetic oligonucleotides of SEQ ID NO: 201 and SEQ ID NO: 202, by the same method as described above.

siRNA expression vector pUH88-4 was prepared from the synthetic oligonucleotides of SEQ ID NO: 203 and SEQ ID NO: 204, by the same method as described above.

siRNA expression vector pUH88-5 was prepared from the synthetic oligonucleotides of SEQ ID NO: 205 and SEQ ID NO: 206, by the same method as described above.

siRNA expression vector pUH88-6 was prepared from the synthetic oligonucleotides of SEQ ID NO: 207 and SEQ ID NO: 208, by the same method as described above.

(3) Expression Inhibition of the Gene of SEQ ID NO: 88 by siRNA Expression Vector Prepared in (2) Above.

EBNA cells (Invitrogen) were inoculated on DMEM medium containing 5% FBS in a 96-well cell culture plate to a cell density of $1.2 \times 10^4$ cells/100 μl/well, and cultured for 24 hours at 37° C. in the presence of 5% $CO_2$. Next, using FuGENE6, 50 ng of an expression vector having the polynucleotide of SEQ ID NO:88 and 50 ng of pNFkB-Luc (STRATAGENE) and 10 ng of phRL-TK vector (Promega Corporation) used as an internal standard, were co-transfected with the siRNA expression vector pUH88-1 (50 ng) prepared in the above (2) into 1 well. After culturing for 24 hours at 37° C., firefly luciferase activity and *Renilla renifor-mis* luciferase activity were measured using Dual-Luciferase Reporter Assay System (Promega Corporation). Further, each of pUH88-2 (50 ng), pUH88-3 (50 ng), pUH88-4 (50 ng), pUH88-5 (50 ng) or pUH88-6 (50 ng) was co-transfected into 1 well in place of pUH88-1 (50 ng), and luciferase activity was measured in the same manner. Results are shown in Table 2. In Table 2, values for activity represent relative values when firefly luciferase activity in the control experiment (cells into which pUH1 was introduced) is established as 100%. (It should be noted that values for firefly luciferase activity were standardized with values for *Renilla reniformis* luciferase activity which was used as an internal standard, before using these values in calculations.) As indicated in Table 2, cells into which expression vector pUH88-1, pUH88-2, pUH88-3, pUH88-4, pUH88-5 or pUH88-6 is introduced, exhibited inhibition of firefly luciferase activity relative to the control experiment (cell into which pUH-1 was introduced). These results indicated that siRNA expressed by pUH88-1, pUH88-2, pUH88-3, pUH88-4, pUH88-5 and pUH88-6 inhibited expression of the gene of SEQ ID NO:88, respectively.

TABLE 2

| Vector | Relative Luciferase Activity (%) |
|---|---|
| pUH1 | 100 |
| pUH88-1 | 20 |
| pUH88-2 | 10 |
| pUH88-3 | 8 |
| pUH88-4 | 7 |
| pUH88-5 | 4 |
| pUH88-6 | 6 |

INDUSTRIAL APPLICABILITY

As described above, the present invention provides industrially highly useful proteins capable of activating NF-κB and genes encoding the proteins. The proteins of the present invention and the genes encoding the proteins allow not only screening for compounds useful for treating and preventing diseases associated with the excessive activation or inhibition of NF-κB, but also production of diagnostics for such diseases. The genes of the present invention are also useful as a gene source used for gene therapy.

All publications, patents and patent applications cited herein are incorporated herein in their entirety.

SEQUENCE LISTING (224 sequences)

SEQ ID NO: 1 - protein, 167 aa, Homo sapiens
MSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 2 - DNA, 1472 bp, Homo sapiens
  CDS (194)..(694)
aaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttcggtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactgtaatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaat

SEQ ID NO: 3 - protein, 339 aa, Homo sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 4 - DNA, 1924 bp, Homo sapiens
  CDS (115)..(1131)
gttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccatcgtggtactccttgggatcgcctttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttcggtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactgtaatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtggaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggg

SEQ ID NO: 5 - protein, 127 aa, Homo sapiens
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIS

SEQ ID NO: 6 - DNA, 702 bp, Homo sapiens
  CDS (225)..(605)
acaatcacagctccgggcattgggggaacccgagccggctgcgccgggggaatccgtgcgggcgtcttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagttaagtgtactctcctctcatccctttcttccctttgagcattgccctctttgggttctttttgagccaattctaataaaagtaaaaatggtaatagt

SEQ ID NO: 7 - protein, 233 aa, Homo sapiens
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPYAQHLHHYGVVLEEDHHDVPTPSASGKSHLCPWDFHDLYQYPSGMVFHRV

SEQ ID NO: 8 - DNA, 2409 bp, Homo sapiens
  CDS (225)..(923)
acaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcccactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaaactacccaagtaagatttactgtattaaatggccttcgggtctgaaaagctttttt

SEQ ID NO: 9 - protein, 198 aa, Homo sapiens
MATLWGGLLRLGSLLSLSCLALSVLLLAQLSDAAKNFEDVRCKCICPPYKENSGHIYNKNISQKDCDCLHVVEPMPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 10 - DNA, 1498 bp, Homo sapiens
  CDS (86)..(679)
gtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaaccc

SEQ ID NO: 11 - protein, 221 aa, Homo sapiens
MALALAALAAVEPACGSRYQQLQNEEESGEPEQAAGDAPPPYSSISAESAAYFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLGFLLFLRGFINYAKVRKMPETFSNLPRTRVLFIY

SEQ ID NO: 12 - DNA, 1864 bp, Homo sapiens
  CDS (153)..(815)
ctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgctatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagc

SEQ ID NO: 13 - protein, 242 aa, Homo sapiens
MDHHQPGTGRYQVLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGLLLFFRGFVNYLKVRNMSESMAAAHRTRYFFLL

SEQ ID NO: 14 - DNA, 2324 bp, Homo sapiens
  CDS (13)..(738)
gagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatatagggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttattttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcct

SEQ ID NO: 15 - protein, 242 aa, Homo sapiens
MDHHQPGTGRYQVLLNEEDNSESSAIEQPPTSNPAPQIVQAVSSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGLLLFFRGFVNYLKVRNMSESMAAAHRTRYFFLL

SEQ ID NO: 16 - DNA, 2324 bp, Homo sapiens
  CDS (13)..(738)
gagccgggcaggatggatcaccaccagccggggactgggcgctaccaggtgcttcttaatgaagaggataactcagaatcatcggctatagagcagccacctacttcaaacccagcaccgcagattgtgcaggctgtgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatatagggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttattttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcct

SEQ ID NO: 17 - protein, 336 aa, Homo sapiens
MARRRSQRVCASGPSMLNSARGAPELLRGTATNAEVSAAAAGATGSEELPPGDRGCRNGGGRGPAATTSSTGVAVGAEHGEDSLSRKPDPEPGRMDHHQPGTGRYQVLLNEEDNSESSAIEQPPTSNPAPQIVQAVSSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGLLLFFRGFVNYLKVRNMSESMAAAHRTRYFFLL

SEQ ID NO: 18 - DNA, 2636 bp, Homo sapiens
  CDS (53)..(1060)
cttacttttccatctcctcccacccagctataccctcccactggcggcgcggatggcacgccggcggagccagcgagtctgcgcgagcggtccgagcatgctcaatagcgcgcgcggcgccccggagcttctccgcggaaccgcgaccaacgcggaggtctcggcggccgctgcgggagccacaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgtgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttgttttaagggacataccagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgct

SEQ ID NO: 19 - protein, 336 aa, Homo sapiens
MARRRSQRVCASGPSMLNSARGAPELLRGTATNAEVSAAAAGATGSEELPPGDRGCRNGGGRGPAATTSSTGVAVGAEHGEDSLSRKPDPEPGRMDHHQPGTGRYQVLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGLLLFFRGFVNYLKVRNMSESMAAAHRTRYFFLL

SEQ ID NO: 20 - DNA, 2636 bp, Homo sapiens
  CDS (53)..(1060)
cttacttttccatctcctcccacccagctataccctcccactggcggcgcggatggcacgccggcggagccagcgagtctgcgcgagcggtccgagcatgctcaatagcgcgcgcggcgccccggagcttctccgcggaaccgcgaccaacgcggaggtctcggcggccgctgcgggagccacaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttgttttaagggacataccagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgct

SEQ ID NO: 21 - protein, 76 aa, Homo sapiens
MVCIPCIVIPVLLWIYKKFLEPYIYPLVSPFVSRIWPKKAIQESNDTNKGKVNFKGADMNGLPTKGPTEICDKKKD

SEQ ID NO: 22 - DNA, 1085 bp, Homo sapiens
  CDS (176)..(403)
gggctagcggcctgggttgggctttgtagctgctccgcaggcccagcccgggccgcgctcgcagagtcctaggcggtgcgcggcctcctgcctcctccctcctcggcggtcgcggcccgccggcctccgcggtgcctgccttcgctctcaggttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagttt

SEQ ID NO: 23 - protein, 84 aa, Homo sapiens
MAIKFLEVIKPFCVILPEIQKPERKIQFKEKVLWTAITLFIFLVCCQIPLFGIMSSDSADPFYWMRVILASNRGTLMEHSLSGL

SEQ ID NO: 24 - DNA, 1593 bp, Homo sapiens
  CDS (65)..(316)
agcgtcgcctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatgagagtgattctagcctctaacagaggcacattgatggagcactctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgtgcacctattggctcttctagctgactcttctcgttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtggtgatcagttgctccagtgtttgaaataagaagactcatgtttatgtctggaataagttctgtttgtgctgacaggtgaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggt

SEQ ID NO: 25 - protein, 179 aa, Homo sapiens
MAIKFLEVIKPFCVILPEIQKPERKIQFKEKVLWTAITLFIFLVCCQIPLFGIMSSDSADPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 26 - DNA, 1820 bp, Homo sapiens
  CDS (114)..(650)
gtgtctctcggcggagctgctgtgcagtggaacgcgctgggccgcgggcagcgtcacctcacgcggagcagagctgagctgaagcgggacccggagcccgagcagccgccgccatggcaatcaaatttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgacccggtccatgcagttgtatacatagtgttcatgctgggctcctgtgcattcttctccaaaacgtggattgaggtctcaggttcctctgccaaagatgttgcaaagcagctgaaggagcagcagatggtgatgagaggccaccgagagacctccatggtccatgaactcaaccggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaatttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacatgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacaraggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactsasataaggtgaataagtgacaaataaagccagttttttacaagg

SEQ ID NO: 27 - protein, 279 aa, Homo sapiens
MEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 28 - DNA, 1472 bp, Homo sapiens
  CDS (119)..(955)
gcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacc

SEQ ID NO: 29 - protein, 137 aa, Homo sapiens
MGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 30 - DNA, 1788 bp, Homo sapiens
  CDS (145)..(555)
gtgcttcctgtggctgacgtcatctggaggagatttgctttctttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatkatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgg

SEQ ID NO: 31 - protein, 118 aa, Homo sapiens
MGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGECPCQL

SEQ ID NO: 32 - DNA, 1908 bp, Homo sapiens
  CDS (91)..(444)
gggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggcctaccacgagaccctggctggtgagtgcccctgccaactctagccctgcccgacttcccgagtctctgccagcatccctcgggcacccatcccaaactacatcactcaacaggcctctgcccctttctgcttgcctgccactcacacggcagcccaccatgctcacagccaaccagggtcctctctgctttcaggaggagcagccgcgccctaccccgccagccagcctccttacaacccggcctacatggatgccccgaaggcggccctctgagcattccctggcctctctggctgccacttggttatgttgtgtgtgtgcgtgagtggtgtgcaggcgcggttccttacgccccatgtgtgctgtgtgtgtccaggcacggttccttacgccccatgtgtgctgtgtgtgtcctgcctgtatatgtggcttcctctgatgctgacaaggtggggaacaatccttgccagagtgggctgggaccagactttgttctcttcctcacctgaaattatgcttcctaaaatctcaagccaaactcaaagaatggggtggtggggggcaccctgtgaggtggcccctgagaggtgggggcctctccagggcacatctggagttcttctccagcttaccctagggtgaccaagtagggcctgtcacaccagggtggcgcagctttctgtgtgatgcagatgtgtcctggtttcggcagcgtagccagctgctgcttgaggccatggctcgtccccggagttgggggtacccgttgcagagccagggacatgatgcaggcgaagcttgggatctggccaagttggactttgatcctttgggcagatgtcccattgctccctggagcctgtcatgcctgttggggatcaggcagcctcctgatgccagaacacctcaggcagagccctactcagctgtacctgtctgcctggactgtcccctgtccccgcatctcccctgggaccagctggagggccacatgcacacacagcctagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttgg

SEQ ID NO: 33 - protein, 168 aa, Homo sapiens
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 34 - DNA, 1897 bp, Homo sapiens
  CDS (70)..(573)
ctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatgccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgc

SEQ ID NO: 35 - protein, 455 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 36 - DNA, 1903 bp, Homo sapiens
  CDS (116)..(1480)
agtcccggctgcagcacctgggagaaggcagaccgtgtgagggggcctgtggccccagcgtgctgtggcctcggggagtgggaagtggaggcaggagccttccttacacttcgccatgagtttcctcatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccgtcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgt

SEQ ID NO: 37 - protein, 322 aa, Homo sapiens
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLPLMSEAGAGLPDMEAVAGAEALNGQSDFPYLGAFPINPGLFIMTPAGVFLAESALHMAGLAEYPMQGELASAISSGKKKRKRCGMCAPCRRRINCEQCSSCRNRKTGHQICKFRKCEELKKKPSAALEKVMLPTGAAFRWFQ

SEQ ID NO: 38 - DNA, 1448 bp, Homo sapiens
  CDS (292)..(1257)
tactgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggctccctctgcagtggggtctgggcctcggccccaccatgtcgagcctcggcggtggctcccaggatgccggcggcagtagcagcagcagcaccaatggcagcggtggcagtggcagcagtggcccaaaggcaggagcagcagacaagagtgcagtggtggctgccgccgcaccagcctcagtggcagatgacacaccaccccccgagcgtcggaacaagagcggtatcatcagtgagcccctcaacaagagcctgcgccgctcccgcccgctctcccactactcttcttttggcagcagtggtggtagtggcggtggcagcatgatgggcggagagtctgctgacaaggccactgcggctgcagccgctgcctccctgttggccaatgggcatgacctggcggcggccatggcggtggacaaaagcaaccctacctcaaagcacaaaagtggtgctgtggccagcctgctgagcaaggcagagcgggccacggagctggcagccgagggacagctgacgctgcagcagtttgcgcagtccacagagatgctgaagcgcgtggtgcaggagcatctcccgctgatgagcgaggcgggtgctggcctgcctgacatggaggctgtggcaggtgccgaagccctcaatggccagtccgacttcccctacctgggcgctttccccatcaacccaggcctcttcattatgaccccggcaggtgtgttcctggccgagagcgcgctgcacatggcgggcctggctgagtaccccatgcagggagagctggcctctgccatcagctccggcaagaagaagcggaaacgctgcggcatgtgcgcgccctgccggcggcgcatcaactgcgagcagtgcagcagttgtaggaatcgaaagactggccatcagatttgcaaattcagaaaatgtgaggaactcaaaaagaagccttccgctgctctggagaaggtgatgcttccgacgggagccgccttccggtggtttcagtgacggcggcggaacccaaagctgccctctccgtgcaatgtcactgctcgtgtggtctccagcaagggattcgggcgaagacaaacggatgcacccgtctttagaaccaaaaatattctctcacagatttcattcctgtttttatatatatattttttgttgtcgttttaacatctccacgtccctagcat

SEQ ID NO: 39 - protein, 313 aa, Homo sapiens
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 40 - DNA, 1597 bp, Homo sapiens
  CDS (153)..(1091)
ggcggaaccgagctgacgggcgtgcggccgctgcgccgcaaactcgtgtgggacgcaccgctccagccgcccgcgggccagcgcaccggtcccccagcggcagccgagcccgcccgcgcgccgttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttggtatcttttcaatcaagctgtgtgcttaatttactctgttgtaaagggataaagtggaaatcatttttt

SEQ ID NO: 41 - protein, 371 aa, Homo sapiens
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 42 - DNA, 1781 bp, Homo sapiens
  CDS (91)..(1203)
attggccatcaccgcgcggccgcgcagcggacaccgtgcgtaccggcctgcggcgcccggccaccggggcggaccgcggaacccgaggccatgtcccatgaaaagagttttttggtgtctggggacaactatcctccccccaaccctggatatccgggggggccccagccacccatgcccccctatgctcagcctccctaccctggggccccttacccacagccccctttccagccctccccctacggtcagccagggtacccccatggccccagcccctacccccaagggggctacccacagggtccctacccccaagggggctacccacagggcccctacccacaagagggctacccacagggcccctacccccaagggggctacccccaggggccatatccccagagccccttcccccccaacccctatggacagccacaggtcttcccaggacaagaccctgactcaccccagcatggaaactaccaggaggagggtcccccatcctactatgacaaccaggacttccctgccaccaactgggatgacaagagcatccgacaggccttcatccgcaaggtgttcctagtgctgaccttgcagctgtcggtgaccctgtccacggtgtctgtgttcacttttgttgcggaggtgaagggctttgtccgggagaatgtctggacctactatgtctcctatgctgtcttcttcatctctctcatcgtcctcagctgttgtggggacttccggcgaaagcacccctggaaccttgttgcactgtcggtcctgaccgccagcctgtcgtacatggtggggatgatcgccagcttctacaacaccgaggcagtcatcatggccgtgggcatcaccacagccgtctgcttcaccgtcgtcatcttctccatgcagacccgctacgacttcacctcatgcatgggcgtgctcctggtgagcatggtggtgctcttcatcttcgccattctctgcatcttcatccggaaccgcatcctggagatcgtgtacgcctcactgggcgctctgctcttcacctgcttcctcgcagtggacacccagctgctgctggggaacaagcagctgtccctgagcccagaagagtatgtgtttgctgcgctgaacctgtacacagacatcatcaacatcttcctgtacatcctcaccatcattggccgcgccaaggagtagccgagctccagctcgctgtgcccgctcaggtggcacggctggcctggaccctgcccctggcacggcagtgccagctgtacttcccctctctcttgtccccaggcacagcctagggaaaaggatgcctctctccaaccctcctgtatgtacactgcagatacttccatttggacccgctgtggccacagcatggcccctttagtcctcccgcccccgccaaggggcagcaaggccacgtttccgtgccacctcctgtctactcattgttgcatgagccctgtctgccagcccaccccagggactgggggcagcaccaggtcccggggagagggattgagccaagaggtgagggtgcacgtcttccctcctgtcccagctccccagcctggcgtagagcacccctcccctcccccccacccccctggagtgctgccctctggggacatgcggagtgggggtcttatccctgtgctgagccctgagggcagagaggatggcatgtttcaggggagggggaagccttcctctcaatttgttgtcagtgaaattccaataaatgggatttgctctctgcc

SEQ ID NO: 43 - protein, 393 aa, Homo sapiens
MSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKEN

SEQ ID NO: 44 - DNA, 2396 bp, Homo sapiens
  CDS (50)..(1228)
agctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccctg

SEQ ID NO: 45 - protein, 393 aa, Homo sapiens
MSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPKGVDIVMDPLGGSDTAKGYNLLKPMGKVVTYGMANLLTGPKRNLMALARTWWNQFSVTALQLLQANRAVCGFHLGYLDGEVELVSGVVARLLALYNQGHIKPHIDSVWPFEKVADAMKQMQEKKNVGKVLLVPGPEKQN

SEQ ID NO: 46 - DNA, 2396 bp, Homo sapiens
  CDS (50)..(1228)
agctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcgcccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaagcagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccctg

SEQ ID NO: 47 - protein, 138 aa, Homo sapiens
MISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGFFPVVVGFIRRVPVLGSLLNLPGIRSFVDKVGESNNMV

SEQ ID NO: 48 - DNA, 2976 bp, Homo sapiens
  CDS (110)..(523)
agacgtggcggctctcgcctgggctgtttcccggcttcatttctcccgactcagcttcccaccctgggctttccgaggtgctgtcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttctttcctgtcgttgttggctttattagaagagtgccagtccttggatccctcctaaatttacctggaattagatcatttgtagataaagttggagaaagcaacaatatggtataacaacaagtgaatttgaagactcatttaaaatattgtgttatttataaagtcatttgaagaatattcagcacaaaattaaattacatgaaatagcttgtaatgttctttacaggagtttaaaacgtatagcctacaaagtaccagcagcaaattagcaaagaagcagtgaaaacaggcttctactcaagtgaactaagaagaagtcagcaagcaaactgagagaggtgaaatccatgttaatgatgcttaagaaactcttgaaggctatttgtgttgtttttccacaatgtgcgaaactcagccatccttagagaactgtggtgcctgtttcttttctttttattttgaaggctcaggagcatccataggcatttgctttttagaaatgtccactgcaatggcaaaaatatttccagttgcactgtatctctggaagtgatgcatgaattcgattggattgtgtcattttaaagtattaaaaccaaggaaaccccaattttgatgtatggattacttttttttgtaaacatggttaaaataaaacttctgtggttcttctgaatcttaatatttcaaagccaggtgaaaatctgaactagatattctttgttggaatatgcaaaggtcattctttactaacttttagttactaaattatagctaagttttgtcagcagcatactccggaaagtctcatacttcttgggagtctgccctcctaagtatctgtctatatcattcattacgtgtaagtatttaacaaaaaagcattcttgaccatgaatgaagtagtttgtttcatagcttgtctcattgaatagtattattgaagatactaaatgatgcaaaccaaatggattttttccatgtcatgatgtaatttttctttcttctttcttttttttaaattttagcagtggcttattatttgtttttcataaattaaaataacttttgataatgtttactttaagacatgtaacatgttaaaaggttaaacttatggctgtttttaaagggctattcatttaatctgagttttcccttattttcagctttttcctagcatataatagtcattaagcatgacatatccttcatatgatcactcatcttgagttaattagaaaatacctgagttcacgtgctaaagtcatttcactgtaataaactgactatggtttcttaagaacatgacactaaaaaaaaagtggtttttttccaccgttgctgattattagacagtaggaaatagctgttttctttagttttacaagatgtgacagctttagtggtagatgtagggaaacatttcaacagccatagtactatttgttttaccactgattgcactgttttgtttttttaacagttgcaaagctttttaatgcataaaagtataattgaaatctgtggtatttatttacaaacatgtctacaaaaatagattacagcttattttatttttagttaaatctcttaatacacagagaactcccaatcttgctcatctaaataaggaaagacttggtgtatagtgtgatggtttagtcttaaggattaagacatttttggtacttgcatttgacttacgatgtatctgtgaaaatgggatgatattgacaaatggagactcctacctcaatagttaatggaataataagaggctactgttgtgtctaatgttcttcaaaaaagtaatatcctcacttggagagtgtcaaatacatactttgaggattgactttatataaggtgccctgtagaactctgttacacatatttttgacccatattatttacaatgtcttgataattctacctttttagagcaagaatagtatctgctaatgtaagggacatctgtatttaactcctttgtagacatgaatttctatcaaaatgttctttgcactgtaacagagattccttttttcaataatcttaattcaaaagcattattagacttgaaagggtttgataatctcccagtccttagtaaagattgagagaggctggagcagttttcagttttaaatgagtctgcagttaatatcaaatgtgagtttgggactgcctggcaacatttatatttcttattcagaacccttgatgagactatttttaaacatactagtctgctgatagaaagcactatacatcctattgtttctttctttccaaaatcagccttctgtctgtaacaaaaatgtactttatagagatggaggaaaaggtctaatactacatagccttaagtgtttctgtcattgttcaagtgtattttctgtaacagaaacatatttggaatgtttttcttttccccttataaattgtaattcctgaaatactgctgctttaaaaagtcccactgtcagattatattatctaacaattgaatattgtaaatatacttgtcttacctctcaataaaagggtacttttctatt

SEQ ID NO: 49 - protein, 359 aa, Homo sapiens
MSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 50 - DNA, 2636 bp, Homo sapiens
  CDS (327)..(1403)
cttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaaccc

SEQ ID NO: 51 - protein, 883 aa, Homo sapiens
MAENSVLTSTTGRTSLADSSIFDSKVTEISKENLLIGSTSYVEEEMPQIETRVILVQEAGKQEELTKALKDIKVGFVKMESVEEFEGLDSPEFENVFVVTDFQDSVFNDLYKADCRVIGPPVVLNCSQKGEPLPFSCRPLYCTSMMNLVLCFTGFRKKEELVRLVTLVHHMGGVIRKDFNSKVTHLVANCTQGEKFRVAVSLGTPIMKPEWIYKAWERRNEQDFYAAVDDFRNEFKVPPFQDCIFSFLGFSDEEKTNMEEMTEMQGGKYLPLGDERCTHLVVEENIVKDLPFEPSKKLYVVKQEWFWGSIQMDARAGETMYLYEKANTPELKKSVSMLSLNTPNSNRKRRRLKETLAQLSRDTDVSPFPPRKRPSAEHSLSIGSLLDISNTPESSINYGDTPKSCTKSSKSSTPVPSKQSARWQVAKELYQTESNYVNILATIIQLFQVPLEEEGQRGGPILAPEEIKTIFGSIPDIFDVHTKIKDDLEDLIVNWDESKSIGDIFLKYSKDLVKTYPPFVNFFEMSKETIIKCEKQKPRFHAFLKINQAKPECGRQSLVELLIRPVQRLPSVALLLNDLKKHTADENPDKSTLEKAIGSLKEVMTHINEDKRKTEAQKQIFDVVYEVDGCPANLLSSHRSLVQRVETISLGEHPCDRGEQVTLFLFNDCLEIARKRHKVIGTFRSPHGQTRPPASLKHIHLMPLSQIKKVLDIRETEDCHNAFALLVRPPTEQANVLLSFQMTSDELPKENWLKMLCRHVANTICKADAENLIYTADPESFEVNTKDMDSTLSRASRAIKKTSKKVTRAFSFSKTPKRALRRALMTSHGSVEGRSPSSNDKHVMSRLSSTSSLAGIPSPSLVSLPSFFERRSHTLSRSTTHLI

SEQ ID NO: 52 - DNA, 3910 bp, Homo sapiens
  CDS (29)..(2677)
agagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttacaaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtatttttagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagatacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaaccc

SEQ ID NO: 53 - protein, 622 aa, Homo sapiens
MEGPGLGSQCRNHSHGPHPPGFGRYGICAHENKELANAREALPLIEDSSNCDIVKATQYGIFERCKELVEAGYDVRQPDKENVSLLHWAAINNRLDLVKFYISKGAVVDQLGGDLNSTPLHWAIRQGHLPMVILLLQHGADPTLIDGEGFSSIHLAVLFQHMPIIAYLISKGQSVNMTDVNGQTPLMLSAHKVIGPEPTGFLLKFNPSLNVVDKIHQNTPLHWAVAAGNVNAVDKLLEAGSSLDIQNVKGETPLDMALQNKNQLIIHMLKTEAKMRANQKFRLWRWLQKCELFLLLMLSVITMWAIGYILDFNSDSWLLKGCLLVTLFFLTSLFPRFLVGYKNLVYLPTAFLLSSVFWIFMTWFILFFPDLAGAPFYFSFIFSIVAFLYFFYKTWATDPGFTKASEEEKKVNIITLAETGSLDFRTFCTSCLIRKPLRSLHCHVCNCCVARYDQHCLWTGRCIGFGNHHYYIFFLFFLSMVCGWIIYGSFIYLSSHCATTFKEDGLWTYLNQIVACSPWVLYILMLATFHFSWSTFLLLNQLFQIAFLGLTSHERISLQKQSKHMKQTLSLRKTPYNLGFMQNLADFFQCGCFGLVKPCVVDWTSQYTMVFHPAREKVLRSV

SEQ ID NO: 54 - DNA, 2426 bp, Homo sapiens
  CDS (104)..(1969)
gcgccagcaggaagtgggagaagaggcgacccaaggcgggctggcgggctggcggcagtcgctacttgcctagtagcctcagccgctgtgggctcctggggagatggaggggccggggctgggctcgcagtgcaggaatcacagccatggcccccaccctccaggatttggtcgatatggcatctgtgcacatgaaaacaaagaacttgccaatgcaagagaagctcttcctcttatagaggactctagtaactgtgacattgtcaaagctactcaatacggaatttttgaacgatgtaaagagttggtagaagcaggatatgatgtcaggcaaccagataaagaaaatgtgtcgcttcttcattgggctgctattaacaacagactggatcttgtaaagttttatatttcaaaaggtgctgttgtagatcagttgggtggagatttaaattcaactcctcttcactgggccatccgacaaggacatttacctatggtcatattattactccagcatggtgcagaccccactcttattgatggagagggattcagcagcatccacctggcagtattgtttcaacacatgcctattatagcatatctcatctcaaagggacagagtgtgaatatgacagatgtaaatgggcagacacctctcatgttatcagctcacaaagtaattgggccagaaccaactggatttcttttaaagtttaatccttctctcaatgtggttgataaaatacaccaaaacactccacttcactgggcagttgcagcaggaaatgttaatgcagttgataagcttttggaagctggttctagcctggatatccagaatgttaagggagaaacacctcttgatatggctctacaaaacaaaaatcagctcattattcatatgctaaaaacagaagccaaaatgagagccaaccaaaagttcagactttggaggtggctgcagaaatgcgagctcttcctgctgctgatgctttctgtgattaccatgtgggctattggatacatattggacttcaattcagattcttggcttttaaaaggatgtcttctagtaacactgttttttctgacatctttgtttccaaggttcttggttgggtataagaaccttgtatacttaccaacagcctttctgctaagttctgttttttggatatttatgacttggttcatcttattttttcctgatttagcaggagcccctttctatttcagtttcattttcagcatagtagcctttctatactttttctataagacttgggcaactgatccaggcttcactaaggcttctgaagaagaaaagaaagtgaatatcatcacccttgcagaaactggctctctggacttcagaacattttgtacatcatgtcttataaggaagccattaaggtcactccactgccatgtatgcaactgctgtgtggctcgatatgatcaacactgcctgtggactggacggtgcataggttttggcaaccatcactattacatattcttcttgtttttcctttccatggtatgtggctggattatatatggatctttcatctatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgataaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgt

SEQ ID NO: 55 - protein, 257 aa, Homo sapiens
MASKIGSRRWMLQLIMQLGSVLLTRCPFWGCFSQLMLYAERAEARRKPDIPVPYLYFDMGAAVLCASFMSFGVKRRWFALGAALQLAISTYAAYIGGYVHYGDWLKVRMYSRTVAIIGGFLVLASGAGELYRRKPRSRSLQSTGQVFLGIYLICVAYSLQHSKEDRLAYLNHLPGGELMIQLFFVLYGILALAFLSGYYVTLAAQILAVLLPPVMLLIDGNVAYWHNTRRVEFWNQMKLLGESVGIFGTAVILATDG

SEQ ID NO: 56 - DNA, 1520 bp, Homo sapiens
  CDS (10)..(780)
tttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgtgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatag

SEQ ID NO: 57 - protein, 107 aa, Homo sapiens
MALFAGGKLRVHLDIQVGEHANNYPEIAAKDKLTELQLRARQLLDQVEQIQKEQDYQRYREERFRLTSESTNQRVLWWSIAQTVILILTGIWQMRHLKSFFEAKKLV

SEQ ID NO: 58 - DNA, 1496 bp, Homo sapiens
  CDS (9)..(329)
ctaccaggatggctctcttcgctggtggcaaactgcgtgtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgacccttcctttttacctcatttatttggtactttccccacacagtcctttatccacctggatttttagggaaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttcactaaataagcaaatgaaaactctctccattaccttctgctttctctttgtccacttacgcagtaggtgactggcatgtgccacagagcaggccctgcctcactgtctgctggtcagttctgggttcacttaatggctttgtgaatgtaaataaggggcaggtcttggccctagaggattgagatgtttttctatatcttagaactatttttggataaattatatattttccttcctagtagaagtgttactgcctgtaactagctcaaaataccaatgcagtttctgcattctgggttttgtttttcttttttttttttttttttttgagttttgctcttgtcgcccaggctggagtgcaatggcgtgatctcagctcactggcaacatctgcctcccgggttcaaatgattctcctgcctcagtctcctgagtagctgggattacaggtgcccgccaccacgctcagctaatttttgtatttttagtagagatggggttttaccatgttggccaggctggtcttagactcctgacctcagttgatccacctgcctcagcctctgcattcagtttattcacatatttttggtaactcccatggcagctcctaggatttcagcggtctgtgggccagaaagcaggcaccagggctgacctcaaggccgtatcagagggccaagcagagttcttttggatacctgcttttcatcccacagggccttagagtcagaggtaaggtagcaacagagctagaatggggcaatgcactcttaccctccttctcaacttttatttaagctgtgctaaatgttttcttcaagggaaccagatttagttctttacagaattttccagtgaaataaaacatgttgtaat

SEQ ID NO: 59 - protein, 272 aa, Homo sapiens
MMIHGFQSSHRDFCFGPWKLTASKTHIMKSADVEKLADELHMPSLPEMMFGDNVLRIQHGSGFGIEFNATDALRCVNNYQGMLKVACAEEWQESRTEGEHSKEVIKPYDWTYTTDYKGTLLGESLKLKVVPTTDHIDTEKLKAREQIKFFEEVLLFEDELHDHGVSSLSVKIRVMPSSFFLLLRFFLRIDGVLIRMNDTRLYHEADKTYMLREYTSRESKISSLMHVPPSLFTEPNEISQYLPIKEAVCEKLIFPERIDPNPADSQKSTQVE

SEQ ID NO: 60 - DNA, 1916 bp, Homo sapiens
  CDS (117)..(932)
atggtaacggctcggaagcctaggaggctgggccggagggaggcggaggaaccggtgttcgccgccgccgctgcttcagcttattccttgtggcctctgcgggtcctgcctcagccatgatgatccacggcttccagagcagccaccgggatttctgcttcgggccctggaagctgacggcgtccaagacccacatcatgaagtcggcggatgtggagaaattagccgatgaattacatatgccatctctccctgaaatgatgtttggagacaacgttttaagaatccagcatgggtctggctttggaattgagttcaatgctacagatgcgttaagatgtgtaaacaactaccaaggaatgcttaaagtggcctgtgctgaagagtggcaagaaagcaggacggagggtgaacactccaaagaggttattaaaccatatgattggacctatacaacagattataagggaaccttacttggagaatctcttaagttaaaggttgtacctacaacagatcatatagatacagaaaaattgaaagccagagaacagattaagttttttgaagaagttctcctttttgaggatgaacttcatgatcatggagtttcaagcctgagtgtgaagattagagtaatgccttctagctttttcctgctgttgcggtttttcttgagaattgatggggtgcttatcagaatgaatgacacgagactttaccatgaggctgacaagacctacatgttacgagaatatacgtcacgagaaagcaaaatttctagtttgatgcatgttccaccttccctcttcacggaacctaatgaaatatcccagtatttaccaataaaggaagcagtttgtgagaagctaatatttccagaaagaattgatcctaacccagcagactcacaaaaaagtacacaagtggaataaaatgtgatacaacatatactcactatggaatctgactggacaccttggctatttgtaaggggttatttttattatgagaattaattgccttgtttatgtacagattttctgtagccttaaaggaaaaaaaaataaagatcgttacaggcaggtttcactcaactgctatttgtactgtctgtcttcacattcatattccagatttatattttctggagttaaatttggatgatttctaaattatcacaaagtgggacctcagcagtagtgatgtgtgtgtctcatgagcagtgagcacagtctgcattcatcatgaaacactatcttctaccaggaggaggttaatgtaaatcaccaaatcccaatgccttgtgactttcataggattcctgatcatgcatgttgatgtactggctcttcactttgggctttctgatgtttattcacacctttggagagttgcaacttgccacatacgaaattagtctcatagtgtagtgaacttcaaccccaaaattttaaaaatgtatttccccccagttttaaattgcctttgaaatttaaaaaaaaaaatttagacttagtaccagaaccaaaaatacctagatttttggagaacttattacatacatagaaacatgaatatggtttaccwctgtgtgtgtgtgtgtgtgtgtgtgtatacagacttttttttttaacttgttgattcagatgtcttggtccctgaatagtcctagattacttattttgagaattgattgttaaaaattacagggaattaaaataattgcctttttttttttagagggtaagagatgggtagaagagtatgcctctgaaaattttattagtttattcttgtggagaataccaagaaaatgtgtatttgcccattgctaaatatgatatatgccattttgtatttatttgtcccaagtgtctttttttaagaggagaataaacaataaggaattactg

SEQ ID NO: 61 - protein, 219 aa, Homo sapiens
MNRLFGKAKPKAPPPSLTDCIGTVDSRAESIDKKISRLDAELVKYKDQIKKMREGPAKNMVKQKALRVLKQKRMYEQQRDNLAQQSFNMEQANYTIQSLKDTKTTVDAMKLGVKEMKKAYKQVKIDQIEDLQDQLEDMMEDANEIQEALSRSYGTPELDEDDLEAELDALGDELLADEDSSYLDEAASAPAIPEGVPTDTKNKDGVLVDEFGLPQIPAS

SEQ ID NO: 62 - DNA, 1362 bp, Homo sapiens
  CDS (49)..(705)
gttttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatgcaaatgaaatccaagaagcactgagtcgcagttatggcaccccagaactggatgaagatgatttagaagcagagttggatgcactaggtgatgagcttctggctgatgaagacagttcttatttggatgaggcagcatctgcacctgcaattccagaaggtgttcccactgatacaaaaaacaaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattccttttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaagg

SEQ ID NO: 63 - protein, 622 aa, Homo sapiens
MADGPDEYDTEAGCVPLLHPEEIKPQSHYNHGYGEPLGRKTHIDDYSTWDIVKATQYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHSVDPTRLLLTFNVSVNLGDKYHKNTALHWAVLAGNTTVISLLLEAGANVDAQNIKGESALDLAKQRKNVWMINHLQEARQAKGYDNPSFLRKLKADKEFRQKVMLGTPFLVIWLVGFIADLNIDSWLIKGLMYGGVWATVQFLSKSFFDHSMHSALPLGIYLATKFWMYVTWFFWFWNDLNFLFIHLPFLANSVALFYNFGKSWKSDPGIIKATEEQKKKTIVELAETGSLDLSIFCSTCLIRKPVRSKHCGVCNRCIAKFDHHCPWVGNCVGAGNHRYFMGYLFFLLFMICWMIYGCISYWGLHCETTYTKDGFWTYITQIATCSPWMFWMFLNSVFHFMWVAVLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 64 - DNA, 2948 bp, Homo sapiens
  CDS (14)..(1879)
atttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatggtggtgtttgggctacagtacagtttctttcaaaatcctttttcgatcattcaatgcatagtgcattgccccttgggatatatttggcaaccaaattctggatgtatgtgacgtggttcttctggttttggaatgatctcaactttttatttatccatcttccattccttgccaatagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctgtgtacatagcacatgtgaataaaagaaaagctgacagtatattctggtttcaataaaatgacctatcagaaagtagaatttc

SEQ ID NO: 65 - protein, 632 aa, Homo sapiens
MQREEGFNTKMADGPDEYDTEAGCVPLLHPEEIKPQSHYNHGYGEPLGRKTHIDDYSTWDIVKATQYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHSVDPTRLLLTFNVSVNLGDKYHKNTALHWAVLAGNTTVISLLLEAGANVDAQNIKGESALDLAKQRKNVWMINHLQEARQAKGYDNPSFLRKLKADKEFRQKVMLGTPFLVIWLVGFIADLNIDSWLIKGLMYGGVWATVQFLSKSFFDHSMHSALPLGIYLATKFWMYVTWFFWFWNDLNFLFIHLPFLANSVALFYNFGKSWKSDPGIIKATEEQKKKTIVELAETGSLDLSIFCSTCLIRKPVRSKHCGVCNRCIAKFDHHCPWVGNCVGAGNHRYFMGYLFFLLFMICWMIYGCISYWGLHCETTYTKDGFWTYITQIATCSPWMFWMFLNSVFHFMWVAVLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 66 - DNA, 4715 bp, Homo sapiens
  CDS (108)..(2003)
gaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatggtggtgtttgggctacagtacagtttctttcaaaatcctttttcgatcattcaatgcatagtgcattgccccttgggatatatttggcaaccaaattctggatgtatgtgacgtggttcttctggttttggaatgatctcaactttttatttatccatcttccattccttgccaatagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctaagtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagttttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactctt

SEQ ID NO: 67 - protein, 498 aa, Homo sapiens
MARLEVIELPHSPQNLLVSPNSSHSHAVVLSWVRPFDGNSPILYYIVELSENNSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTMHEYKIQGLSSLTTYTIDVAAVTAVGTGLVTSSTISSGVPPDLPGAPSNLVISNISPRSATLQFRPGYDGKTSISRWIVEGQMRPEGVGLPAEVTQPSHEAGLEPANLGSLWLLSLVYWCYSQKLWEFSC

SEQ ID NO: 68 - DNA, 1902 bp, Homo sapiens
  CDS (22)..(1515)
gaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctgtctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagtgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgatgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcagatgagacctgaaggtgttggattacctgccgaggtcacacagccaagccatgaagccggattggagcctgcaaacctcggaagtctgtggctgctcagcctggtgtattggtgttacagccagaaactttgggaattctcttgttagttggttagttttactgtaattttctataaagaattcatatcatctgttaatggcgacagtttttgtttcttcctttgaattttttatattctttctttctcttttttgtttcttcttctttgagtattttgtaatcttactgggagggctaaagcgtcttctatcatatcgaattgggacaatgatagaagacaatctttgttttgtcactctaaagaaattattgtaagattttatcatcaggtatgacatttacaccattgatgtaggctttttaaaaaatatatccagcctgtattgggttaagatgattcttttctgatcctgatttcctaggagttggtttttttttttttaaagcataaataaatttaattgcatcag

SEQ ID NO: 69 - protein, 498 aa, Homo sapiens
MARLEVIELPHSPQNLLVSPNSSHSHAVVLSWVRPFDGNSPILYYIVELSENNSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVTAVGTGLVTSSTISSGVPPDLPGAPSNLVISNISPRSATLQFRPGYDGKTSISRWIVEGQMRHQGVGLPAEVTQPSHEAGLEPANLGSLWLLSLVYWCYSQKLWEFSC

SEQ ID NO: 70 - DNA, 1902 bp, Homo sapiens
  CDS (22)..(1515)
gaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctgtctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagtgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcagatgagacatcaaggtgttggattacctgccgaggtcacacagccaagccatgaagccggattggagcctgcaaacctcggaagtctgtggctgctcagcctggtgtattggtgttacagccagaaactttgggaattctcttgttagttggttagttttactgtaattttctataaagaattcatatcatctgttaatggcgacagtttttgtttcttcctttgaattttttatattctttctttctcttttttgtttcttcttctttgagtattttgtaatcttactgggagggctaaagcgtcttctatcatatcgaattgggacaatgatagaagacaatctttgttttgtcactctaaagaaattattgtaagattttatcatcaggtatgacatttacaccattgatgtaggctttttaaaaaatatatccagcctgtattgggttaagatgattcttttctgatcctgatttcctaggagttggtttttttttttttaaagcataaataaatttaattgcatcag

SEQ ID NO: 71 - protein, 245 aa, Homo sapiens
MPVQLSEHPEWNESMHSLRISVGGLPVLASMTKAADPRFRPRWKVILTFFVGAAILWLLCSHRPAPGRPPTHNAHNWRLGQAPANWYNDTYPLSPPQRTPAGIRYRIAVIADLDTESRAQEENTWFSYLKKGYLTLSDSGDKVAVEWDKDHGVLESHLAEKGRGMELSDLIVFNGKLYSVDDRTGVVYQIEGSKAVPWVILSDGDGTVEKGFKAEWLAVREIVRKRWRLVKQVSHVGVLGQWIQR

SEQ ID NO: 72 - DNA, 1551 bp, Homo sapiens
  CDS (127)..(861)
ggaagtcggccaccttcctccgtcccggccgttagcccagccaagcccagccaagcccagccaagccccgccgatcgcgggcaccggagccagccccgcagcgggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggag

SEQ ID NO: 73 - protein, 352 aa, Homo sapiens [sequence omitted]

SEQ ID NO: 74 - DNA, 2401 bp, Homo sapiens
  CDS (103)..(1158)
ttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtgccttatgctgttatagaaggagctgtgcggtctgttaaagaaacgcttaacagccagtttgtggaaaactgcaagggggtaattcagcggctgacacttcaggagcacaagatggtgtggaatcgaaccacccacctttggaatgattgctcaaagatcattcatcagaggaccaacacagtgccctttgacctggtgccccacgaggatggcgtggatgtggctgtgcgagtgctgaagcccctggactcagtggatctgggtctagagactgtgtatgagaagttccacccctcgattcagtccttcaccgatgtcatcggccactacatcagcggtgagcggcccaaaggcatccaagagaccgaggagatgctgaaggtgggggccaccctcacaggggttggcgaactggtcctggacaacaactctgtccgcctgcagccgcccaaacaaggcatgcagtactatctaagcagccaggacttcgacagcctgctgcagaggcaggagtcgagcgtcaggctctggaaggtgctggcgctggtttttggctttgccacatgtgccaccctcttcttcattctccggaagcagtatctgcagcggcaggagcgcctgcgcctcaagcagatgcaggaggagttccaggagcatgaggcccagctgctgagccgagccaagcctgaggacagggagagtctgaagagcgcctgtgtagtgtgtctgagcagcttcaagtcctgcgtctttctggagtgtgggcacgtttgttcctgcaccgagtgctaccgcgccttgccagagcccaagaagtgccctatctgcagacaggcgatcacccgggtgatacccccgtacaacagctaatagtttggaagccgcacagcttgacctggaagcacccctgcccccttttcagggatttttatctcgaggcctttggaggagcagtggtgggggtagctgtcacctccaggtatgattgagggaggaatcgggtagaaactctccagacccatgcctccaatggcaggatgctgcctttcccacctgagaggggaccctgtccatgtgcagcctcatcagagcctcaccctgggaggatgccgtggcgtctcctcccaggagccagatcagtgcgagtgtgactgaaaatgcctcatcacttaagcaccaaagccagtgatcagcagctcttctgttcctgtgtcttctgtttttttctggtgaatcgttgcttgctgtggacttggtggaggactcagaggggaggaaaggctgggccccgagtacaacggatgccttgggtgctgcctccgaagagactctgccgcagcttttcttctttttcctcatgccccgggaaacagtctttcttcagaattgtcaggctgggcaggtcaacttgtgttcctttcccctcacctgcttgcctccttaacgcctgcacgtgtgtgtagaggacaaaagaaagtgaagtcagcacatccgcttctgcccagatggtcggggccccgggcaacagattgaagagagatcatgtgaagggcagttggtcaggcaggcctcctggtttcgccactggccctgatttgaactcctgccacttgggagagctcggggtggtccctggttttccctcctggagaatgaggcgcagaggcctcgcctcctgaaggacgcagtgtggatgccactggcctagtgtcctggcctcacagcttccttgcaaggctgtcacaaggaaaagcagccggctggcaccctgagcatatgccctcttggggctccctcatccagcccgtcgcagctttgacatcttggtgtactcatgtcgcttctccttgtgttaccccctcccagtattaccatttgcccctcacctgcccttggtgagccttttagtgcaagacagatggggctgttttcccccacctctgagtagttggaggtcacatacacagctctttttttattgcccttttctgcctctgaatgttcatctctcgtcctcctttgtgcaggcgaggaaggggtgccctcaggggccgacactagtgtgatgcagtgtccagtgtgaacagcagaaattaaacatgttgcaacc

SEQ ID NO: 75 - protein, 352 aa, Homo sapiens
MESGGRPSLCQFILLGTTSVVTAALYSVYRQKARVSQELKGAKKVHLGEDLKSILSEAPGKCVPYAVIEGAVRSVKETLNSQFVENCKGVIQRLTLQEHKMVWNRTTHLWNDCSKIIHQRTNTVPFDLVPHEDGVDVAVRVLKPLDSVDLGLETVYEKFHPSIQSFTDVIGHYISGERPKGIQETEEMLKVGATLTGVGELVLDNNSVRLQPPKQGMQYYLSSQDFDSLLQRQESSVRLWKVLALVFGFATCATLFFILRKQYLQRQERLRLKQMQEEFQEHEAQLLSRAKPEDRESLKSACVVCLSSFKSCVFLECGHVCSCTECYRALPEPKKCPICRQAITRVIPLYNS

SEQ ID NO: 76 - DNA, 2401 bp, Homo sapiens
  CDS (103)..(1158)
ttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtgccttatgctgttatagaaggagctgtgcggtctgttaaagaaacgcttaacagccagtttgtggaaaactgcaagggggtaattcagcggctgacacttcaggagcacaagatggtgtggaatcgaaccacccacctttggaatgattgctcaaagatcattcatcagaggaccaacacagtgccctttgacctggtgccccacgaggatggcgtggatgtggctgtgcgagtgctgaagcccctggactcagtggatctgggtctagagactgtgtatgagaagttccacccctcgattcagtccttcaccgatgtcatcggccactacatcagcggtgagcggcccaaaggcatccaagagaccgaggagatgctgaaggtgggggccaccctcacaggggttggcgaactggtcctggacaacaactctgtccgcctgcagccgcccaaacaaggcatgcagtactatctaagcagccaggacttcgacagcctgctgcagaggcaggagtcgagcgtcaggctctggaaggtgctggcgctggtttttggctttgccacatgtgccaccctcttcttcattctccggaagcagtatctgcagcggcaggagcgcctgcgcctcaagcagatgcaggaggagttccaggagcatgaggcccagctgctgagccgagccaagcctgaggacagggagagtctgaagagcgcctgtgtagtgtgtctgagcagcttcaagtcctgcgtctttctggagtgtgggcacgtttgttcctgcaccgagtgctaccgcgccttgccagagcccaagaagtgccctatctgcagacaggcgatcacccgggtgatacccctgtacaacagctaatagtttggaagccgcacagcttgacctggaagcacccctgcccccttttcagggatttttatctcgaggcctttggaggagcagtggtgggggtagctgtcacctccaggtatgattgagggaggaatcgggtagaaactctccagacccatgcctccaatggcaggatgctgcctttcccacctgagaggggaccctgtccatgtgcagcctcatcagagcctcaccctgggaggatgccgtggcgtctcctcccaggagccagatcagtgcgagtgtgactgaaaatgcctcatcacttaagcaccaaagccagtgatcagcagctcttctgttcctgtgtcttctgtttttttctggtgaatcgttgcttgctgtggacttggtggaggactcagaggggaggaaaggctgggccccgagtacaacggatgccttgggtgctgcctccgaagagactctgccgcagcttttcttctttttcctcatgccccgggaaacagtctttcttcagaattgtcaggctgggcaggtcaacttgtgttcctttcccctcacctgcttgcctccttaacgcctgcacgtgtgtgtagaggacaaaagaaagtgaagtcagcacatccgcttctgcccagatggtcggggccccgggcaacagattgaagagagatcatgtgaagggcagttggtcaggcaggcctcctggtttcgccactggccctgatttgaactcctgccacttgggagagctcggggtggtccctggttttccctcctggagaatgaggcgcagaggcctcgcctcctgaaggacgcagtgtggatgccactggcctagtgtcctggcctcacagcttccttgcaaggctgtcacaaggaaaagcagccggctggcaccctgagcatatgccctcttggggctccctcatccagcccgtcgcagctttgacatcttggtgtactcatgtcgcttctccttgtgttaccccctcccagtattaccatttgcccctcacctgcccttggtgagccttttagtgcaagacagatggggctgttttcccccacctctgagtagttggaggtcacatacacagctctttttttattgcccttttctgcctctgaatgttcatctctcgtcctcctttgtgcaggcgaggaaggggtgccctcaggggccgacactagtgtgatgcagtgtccagtgtgaacagcagaaattaaacatgttgcaacc

SEQ ID NO: 77 - protein, 697 aa, Homo sapiens
MCKSLRYCFSHCLYLAMTRLEEVNREVNMHSSVRYLGYLARINLLVAICLGLYVRWEKTANSLILVIFILGLFVLGIASILYYYFSMEAASLSLSNLWFGFLLGLLCFLDNSSFKNDVKEESTKYLLLTSIVLRILCSLVERISGYVRHRPTLLTTVEFLELVGFAIASTTMLVEKSLSVILLVVALAMLIIDLRMKSFLAIPNLVIFAVLLFFSSLETPKNPIAFACFFICLITDPFLDIYFSGLSVTERWKPFLYRGRICRRLSVVFAGMIELTFFILSAFKLRDTHLWYFVIPGFSIFGIFWMICHIIFLLTLWGFHTKLNDCHKVYFTHRTDYNSLDRIMASKGMRHFCLISEQLVFFSLLATAILGAVSWQPTNGIFLSMFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 78 - DNA, 3008 bp, Homo sapiens
  CDS (372)..(2462)
cgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggttatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcacaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcac

SEQ ID NO: 79 - protein, 611 aa, Homo sapiens [sequence omitted]

SEQ ID NO: 80 - DNA, 3007 bp, Homo sapiens
  CDS (629)..(2461)
cgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttgctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggttatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcacaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcac

SEQ ID NO: 81 - protein, 184 aa, Homo sapiens
MTSFEDADTEETVTCLQMTVYHPGQLQCGIFQSISFNREKLPSSEVVKFGRNSNICHYTFQDKQVSRVQFSLQLFKKFNSSVLSFEIKNMSKKTNLIVDSRELGYLNKMDLPYRCMVRFGEYQFLMEKEDGESLEFFETQFILSPRSLLQENNWPPHRPIPEYGTYSLCSSQSSSPTEMDENES

SEQ ID NO: 82 - DNA, 1617 bp, Homo sapiens
  CDS (285)..(836)
tttttacaaaggccccgggcgcgagaggacgtgctctgccagccagtgggaaggcaggccgcgcgcgcgggagcgcgggaggatcggcggctcgcggtcactggtccctggctcggttccccgcaccccggggctcacacttacccgcgcggaggagcagcggccgggtgtccacccccatcctgcgcccagtctcctcgattcccctcgctctgagccgggagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttattcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctgttatgctgtgaaatttggaattcagtattatcattttgaagtctgtaaattgtgttagtcattaacttagtcacctgttgtattctggatctacacaaaattattttaactgctcttattaatctgtgaggattaatatacaaaaagtatcctttgagatgaagtcgtgttctcaaaataaggttatattattttctttttctgcttgattttcatcttgtgttttgctttgtttttgtaaggaaccatctcttggtttggtcacatcagttcacaacagccatttgttttcaaggtcaaggctccaggcaggttgttactggtgtttgcagcctgtcagtacttgcagtactggaataggttctaggctagtgtctgcgcgtcactgtggttttagcatgggaggacttatttgagaaatactaccttacttttctatgatttctttttacagagttatagtgtgtttactcctaagatgacagttctctttgtctatattcagcatctaagacaaatatttaaacattttaaagaaccactgtgttaagtttaggattatttacttaccaaattagaagtttgacttttatgtgttatacacaatcttaaaatttcacgaattcacctttttaatagtatccatgtacataataaaatcaaagtttaattagc

SEQ ID NO: 83 - protein, 392 aa, Homo sapiens
MDARWWAVVVLAAFPSLGAGGETPEAPPESWTQLWFFRFVVNAAGYASFMVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 84 - DNA, 1898 bp, Homo sapiens
  CDS (119)..(1294)
acttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccacagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgc

SEQ ID NO: 85 - protein, 432 aa, Homo sapiens
MDARWWAVVVLAAFPSLGAGGETPEAPPESWTQLWFFRFVVNAAGYASFMVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 86 - DNA, 2018 bp, Homo sapiens
  CDS (119)..(1414)
acttccgctggccgctggctcgctggccgctcctggaggcggcggcgggagcgcagggggcgcgcggcccggggactcgcattccccggttccccctccaccccacgcggcctggaccatggacgccagatggtgggcagtggtggtgctggctgcgttcccctccctaggggcaggtggggagactcccgaagcccctccggagtcatggacccagctatggttcttccgatttgtggtgaatgctgctggctatgccagctttatggtacctggctacctcctggtgcagtacttcaggcggaagaactacctggagaccggtaggggcctctgctttcccctggtgaaagcttgtgtgtttggcaatgagcccaaggcctctgatgaggttcccctggcgccccgaacagaggcggcagagaccaccccgatgtggcaggccctgaagctgctcttctgtgccacagggctccaggtgtcttatctgacttggggtgtgctgcaggaaagagtgatgacccgcagctatggggccacagccacatcaccgggtgagcgctttacggactcgcagttcctggtgctaatgaaccgagtgctggcactgattgtggctggcctctcctgtgttctctgcaagcagccccggcatggggcacccatgtaccggtactcctttgccagcctgtccaatgtgcttagcagctggtgccaatacgaagctcttaagttcgtcagcttccccacccaggtgctggccaaggcctctaaggtgatccctgtcatgctgatgggaaagcttgtgtctcggcgcagctacgaacactgggagtacctgacagccaccctcatctccattggggtcagcatgtttctgctatccagcggaccagagccccgcagctccccagccaccacactctcaggcctcatcttactggcaggttatattgcttttgacagcttcacctcaaactggcaggatgccctgtttgcctataagatgtcatcggtgcagatgatgtttggggtcaatttcttctcctgcctcttcacagtgggctcactgctagaacagggggccctactggagggaacccgcttcatggggcgacacagtgagtttgctgcccatgccctgctactctccatctgctccgcatgtggccagctcttcatcttttacaccattgggcagtttggggctgccgtcttcaccatcatcatgaccctccgccaggcctttgccatccttctttcctgccttctctatggccacactgtcactgtggtgggagggctgggggtggctgtggtctttgctgccctcctgctcagagtctacgcgcggggccgtctaaagcaacggggaaagaaggctgtgcctgttgagtctcctgtgcagaaggtttgagggtggaaagggcctgaggggtgaagtgaaataggaccctcccaccatccccttctgctgtaacctctgagggagctggctgaaagggcaaaatgcaggtgttttctcagtatcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccacagttactcttcccacaagttcccttaagtcttgccctagctgtgctctgccaccttccagactcactcccctctgcaaatacctgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttagaaatgtaactttttgctcttataattttattttattaaattaaattactgc

SEQ ID NO: 87 - protein, 235 aa, Homo sapiens
MGIGKSKINSCPLSLSWGKRHSVDTSPGYHESDSKKSEDLSLCNVAEHSNTTEGPTGKQEGAQSVEEMFEEEAEEEVFLKFVILHAEDDTDEALRVQNLLQDDFGIKPGIIFAEMPCGRQHLQNLDDAVNGSAWTILLLTENFLRDTWCNFQFYTSLMNSVNRQHKYNSVIPMRPLNNPLPRERTPFALQTINALEEESRGFPTQVERIFQESVYKTQQTIWKETRNMVQRQFIA

SEQ ID NO: 88 - DNA, 2717 bp, Homo sapiens
  CDS (111)..(815)
aaaaggaagacagaaaagccgcgggctgactgtggtggcgctcgcctgcagattgaaaagaaatgctgagaaatacataaagttttcctcttctgccttggatatttataatgggtatcgggaagtctaaaataaattcctgccctctttctctctcttggggtaaaaggcacagtgtggatacaagtccaggatatcatgagtcagattccaagaagtctgaagatctatccttgtgtaatgttgctgagcacagcaatacaacagaggggccaacaggaaagcaggagggagctcagagcgtggaagagatgtttgaagaagaagctgaagaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttagatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattcttt

SEQ ID NO: 89 - protein, 245 aa, Homo sapiens
MASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQLIGIFLAYCLSRAITNNQYEIV

SEQ ID NO: 90 - DNA, 1793 bp, Homo sapiens
  CDS (60)..(794)
gcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctct

SEQ ID NO: 91 - protein, 180 aa, Homo sapiens
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 92 - DNA, 970 bp, Homo sapiens
  CDS (26)..(565)
tttttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggctgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacctt

SEQ ID NO: 93 - protein, 331 aa, Homo sapiens
MDSEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 94 - DNA, 2039 bp, Homo sapiens
  CDS (175)..(1167)
attatgcagatgcacggctggaggtgggatccacacagctcagaacagctggatcttgctcacactctttcaagagaagcttccttgggttaagaaaaaaaacgaacccttccagtcaggtcagtgactggagagctccaaggaaagtctctcagtgacctggctgctggcaccatggactcagaaaagaaacgctttactgaagaggccaccaaatacttccgggagagagtcagcccagtgcatctgcaaatcctgctgactaacaatgaagcctggaagagattcgtgactgcggctgaattgcccagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaacgtggtgtccagctccactggcgctgcctctggcatcatgtcccttgctggtcttgttttggcaccatttacagcagggacgagtctggcccttactgcagctggggtagggctgggagcagcgtctgctgtgactgggatcaccaccagcatcgtggagcactcatacacatcatcagcagaagctgaagccagcaggctgactgcaaccagcattgaccgattgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggtggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggaggagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcacc

SEQ ID NO: 95 - protein, 407 aa, Homo sapiens
MELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETPLPPSNLPASPLMKNFDTSQWEDIKLVDVDKLSLPQDTGTFISKIPWSFYKLFLLILLLGLVIVFGPTMFLEWSLFDDLATWKGCLSNFSSYLTKTADFIEQSVFYWEQVTDGFFIFNERFKNFTLVVLNNVAEFVCKYKLL

SEQ ID NO: 96 - DNA, 1409 bp, Homo sapiens
  CDS (181)..(1401)
gctgtgcttggcgcgtaccgtgcggtccctgtagttggaggacgggcggtcgcgcggcctttcccactagccggagtagcctctagttcgttagtcaaaacgtgaaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatcg

SEQ ID NO: 97 - protein, 465 aa, Homo sapiens
MASTTSTKKMMEEATCSICLSLMTNPVSINCGHSYCHLCITDFFKNPSQKQLRQETFCCPQCRAPFHMDSLRPNKQLGSLIEALKETDQEMSCEEHGEQFHLFCEDEGQLICWRCERAPQHKGHTTALVEDVCQGYKEKLQEAVTKLKQLEDRCTEQKLSTAMRITKWKEKVQIQRQKIRSDFKNLQCFLHEEEKSYLWRLEKEEQQTLSRLRDYEAGLGLKSNELKSHILELEEKCQGSAQKLLQNVNDTLSRSWAVKLETSEAVSLELHTMCNVSKLYFDVKKMLRSHQVSVTLDPDTAHHELILSEDRRQVTRGYTQENQDTSSRRFTAFPCVLGCEGFTSGRRYFEVDVGEGTGWDLGVCMENVQRGTGMKQEPQSGFWTLRLCKKKGYVALTSPPTSLHLHEQPLLVGIFLDYEAGVVSFYNGNTGCHIFTFPKASFSDTLRPYFQVYQYSPLFLPPPGD

SEQ ID NO: 98 - DNA, 1940 bp, Homo sapiens
  CDS (477)..(1871)
gttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaagttctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccaggaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcag

SEQ ID NO: 99 - protein, 465 aa, Homo sapiens
MASTTSTKKMMEEATCSICLSLMTNPVSINCGHSYCHLCITDFFKNPSQKQLRQETFCCPQCRAPFHMDSLRPNKQLGSLIEALKETDQEMSCEEHGEQFHLFCEDEGQLICWRCERAPQHKGHTTALVEDVCQGYKEKLQKAVTKLKQLEDRCTEQKLSTAMRITKWKEKVQIQRQKIRSDFKNLQCFLHEEEKSYLWRLEKEEQQTLSRLRDYEAGLGLKSNELKSHILELEEKCQGSAQKLLQNVNDTLSRSWAVKLETSEAVSLELHTMCNVSKLYFDVKKMLRSHQVSVTLDPDTAHHELILSEDRRQVTRGYTQENQDTSSRRFTAFPCVLGCEGFTSGRRYFEVDVGEGTGWDLGVCMENVQRGTGMKQEPQSGFWTLRLCKKKGYVALTSPPTSLHLHEQPLLVGIFLDYEAGVVSFYNGNTGCHIFTFPKASFSDTLRPYFQVYQYSPLFLPPPGD

SEQ ID NO: 100 - DNA, 1940 bp, Homo sapiens
  CDS (477)..(1871)
gttaacttcctgacccaggaagtggcagcaacagaggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaagttctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcag

SEQ ID NO: 101 - protein, 685 aa, Homo sapiens
MELLRTITYQPAASTKMCEQALGKGCGADSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFLQGFTPDRLSSSCCHTVPDFHLSSPAKNFFKKAAAALFGGKKDKARYIDTHNRVSKEDEDIYKLRHDLKKTSITQQPSKHRTDEELQPPTTTVARSGTPAVENKQQIGDAIRMIVRGTLGSCSSSSECLEDSTMGSVADTVARVLRGCLENMPEADCIPKEQLSTSFQWVTKWVDYSNKYGFGYQLSDHTVGVLFNNGAHMSLLPDKKTVHYYAELGQCSVFPATDAPEQFISQVTVLKYFSHYMEENLMDGGDLPSVTDIRRPRLYLLQWLKSDKALMMLFNDGTFQVNFYHDHTKIIICSQNEEYLLTYINEDRISTTFRLTTLLMSGCSSELKNRMEYALNMLLQRCN

SEQ ID NO: 102 - DNA, 2783 bp, Homo sapiens
  CDS (128)..(2182)
gcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcagactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaacccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcag

SEQ ID NO: 103 - protein, 161 aa, Homo sapiens
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 104 - DNA, 1589 bp, Homo sapiens
  CDS (70)..(552)
ccttttctcggggcgcccgaaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatactttcgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcactt

SEQ ID NO: 105 - protein, 161 aa, Homo sapiens
MSVPGPYQAATGPSSAPSAPPSYEETVAVNSYYPTPPAPMPGPTTGLVTGPDGKGMNPPSYYTQPAPIPNNNPITVQTVYVQHPITFLDRPVQMCCPSCNKMIVSQLSYNAGALTWLSCGSLCLLGCIAGCCFIPFCVDALQDVDHYCPNCRALLGTYKRL

SEQ ID NO: 106 - DNA, 1589 bp, Homo sapiens
  CDS (70)..(552)
ccttttctcggggcgcccgaaggccagctcagacctcccggctcgacaggcggcgcgggcggcggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctgtccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatactttcgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcactt

SEQ ID NO: 107 - protein, 249 aa, Homo sapiens
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEAKPDELMDSKLRCVFEMPNENDKLNDMEPSKAVPLNASKQDGPMPKPHSVSLNDTETRKLMEECKRLQGEMMKLSEENRHLRDEGLRLRKVAHSDKPGSTSTASFRDNVTSPLPSLLVVIAAIFIGFFLGKFIL

SEQ ID NO: 108 - DNA, 1595 bp, Homo sapiens
  CDS (232)..(978)
agtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagcaaaccgccgccgcgggcgcgcccccgctctgcgctgtctctccgatggcgtccgcctcaggggccatggcgaagcacgagcagatcctggtcctcgatccgcccacagacctcaaattcaaaggccccttcacagatgtagtcactacaaatcttaaattgcgaaatccatcggatagaaaagtgtgtttcaaagtgaagactacagcacctcgccggtactgtgtgaggcccaacagtggaattattgacccagggtcaactgtgactgtttcagtaatgctacagccctttgactatgatccgaatgaaaagagtaaacacaagtttatggtacagacaatttttgctccaccaaacacttcagatatggaagctgtgtggaaagaggcaaaacctgatgaattaatggattccaaattgagatgcgtatttgaaatgcccaatgaaaatgataaattgaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgat

SEQ ID NO: 109 - protein, 540 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 110 - DNA, 1810 bp, Homo sapiens
  CDS (102)..(1721)
aaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcggtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttg

SEQ ID NO: 111 - protein, 540 aa, Homo sapiens
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDISRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 112 - DNA, 1810 bp, Homo sapiens
  CDS (102)..(1721)
aaccgtaacagccaccagacaagcttcagtggccggcccttcacatccagacttgcctgagaggacccacctctgagtgtccagtggtcagttgccccaggatggggaccacagccagagcagccttggtcttgacctatttggctgttgcttctgctgcctctgagggaggcttcacggctacaggacagaggcagctgaggccagagcactttcaagaagttggctacgcagctcccccctccccacccctatcccgaagcctccccatggatcaccctgactcctctcagcatggccctccctttgagggacagagtcaagtgcagccccctccctctcaggaggccacccctctccaacaggaaaagctgctacctgcccaactccctgctgaaaaggaagtgggtccccctctccctcaggaagctgtccccctccaaaaagagctgccctctctccagcaccccaatgaacagaaggaaggaacgccagctccatttggggaccagagccatccagaacctgagtcctggaatgcagcccagcactgccaacaggaccggtcccaagggggctggggccaccggctggatggcttcccccctgggcggccttctccagacaatctgaaccaaatctgccttcctaaccgtcagcatgtggtatatggtccctggaacctaccacagtccagctactcccacctcactcgccagggtgagaccctcaatttcctggagattggatattcccgctgctgccactgccgcagccacacaaaccgcctagagtgtgccaaacttgtgtgggaggaagcaatgagccgattctgtgaggccgagttctcggtcaagacccgaccccactggtgctgcacgcggcagggggaggctcggttctcctgcttccaggaggaagctccccagccacactaccagctccgggcctgccccagccatcagcctgatatttcctcgggtcttgagctgcctttccctcctggggtgcccacattggacaatatcaagaacatctgccacctgaggcgcttccgctctgtgccacgcaacctgccagctactgaccccctacaaagggagctgctggcactgatccagctggagagggagttccagcgctgctgccgccaggggaacaatcacacctgtacatggaaggcctgggaggatacccttgacaaatactgtgaccgggagtatgctgtgaagacccaccaccacttgtgttgccgccaccctcccagccctactcgggatgagtgctttgcccgtcgggctccttaccccaactatgaccgggacatcttgaccattgacatcagtcgagtcacccccaacctcatgggccacctctgtggaaaccaaagagttctcaccaagcataaacatattcctgggctgatccacaacatgactgcccgctgctgtgacctgccatttccagaacaggcctgctgtgcagaggaggagaaattaaccttcatcaatgatctgtgtggtccccgacgtaacatctggcgagaccctgccctctgctgttacctgagtcctggggatgaacaggtcaactgcttcaacatcaattatctgaggaacgtggctctagtgtctggagacactgagaacgccaagggccagggggagcagggctcaactggaggaacaaatatcagctccacctctgagcccaaggaagaatgagtcaccccagagccctagagggtcagatggggggaaccccaccctgccccacccatctgaacactcattacactaaacacctcttg

SEQ ID NO: 113 - protein, 382 aa, Homo sapiens
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQTWANYSAEQNRMGQAGSTISNSHAQPFDFPDDNQNSKKLAAGHELQPLAIVDQRPSSRASSRASSRPRPDDLEI

SEQ ID NO: 114 - DNA, 3074 bp, Homo sapiens
  CDS (201)..(1346)
aacttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaacctgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtat

SEQ ID NO: 115 - protein, 382 aa, Homo sapiens
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 116 - DNA, 3074 bp, Homo sapiens
  CDS (201)..(1346)
aacttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtat

SEQ ID NO: 117 - protein, 398 aa, Homo sapiens
MEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSKLEDNIRRLRALADGVQKVHKGTTIANVVSGSLSISSGILTLVGMGLAPFTEGGSLVLLEPGMELGITAALTGITSSTIDYGKKWWTQAQAHDLVIKSLDKLKEVKEFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 118 - DNA, 2054 bp, Homo sapiens
  CDS (76)..(1269)
cacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagagttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaactttttttttttctgagacagagtcttgctctgtcgccaagttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgagccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtccccgcccaggattgacctgtgtaagtcccaataaactcacctactcatc

SEQ ID NO: 119 - protein, 398 aa, Homo sapiens
MEGAALLRVSVLCIWMSALFLGVRVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSKLEDNIRRLRALADGVQKVHKGTTIANVVSGSLSISSGILTLVGMGLAPFTEGGSLVLLEPGMELGITAALTGITSSTIDYGKKWWTQAQAHDLVIKSLDKLKEVKEFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 120 - DNA, 2054 bp, Homo sapiens
  CDS (76)..(1269)
cacacagctcagaacagctggatcttgctcagtctctgccaggggaagattccttggaggaggccctgcagcgacatggagggagctgctttgctgagagtctctgtcctctgcatctggatgagtgcacttttccttggtgtgagagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagcagctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagagttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaactttttttttttctgagacagagtcttgctctgtcgccaagttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtcccctccaggttactaaagggtgcatgtcccctgcttgaacactgaagggcaggtggtgagccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtccccgcccaggattgacctgtgtaagtcccaataaactcacctactcatc

SEQ ID NO: 121 - protein, 108 aa, Homo sapiens
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 122 - DNA, 1546 bp, Homo sapiens
  CDS (89)..(412)
actaggcagagccgtggaaccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgaatccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttactcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggcctttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgccggcttttctc

SEQ ID NO: 123 - protein, 679 aa, Homo sapiens
MATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 124 - DNA, 2916 bp, Homo sapiens
  CDS (81)..(2117)
tttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccctatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttag

SEQ ID NO: 125 - protein, 288 aa, Homo sapiens
MERPQPDSMPQDLSEALKEATKEVHTQAENAEFMRNFQKGQVTRDGFKLVMASLYHIYVALEEEIERNKESPVFAPVYFPEELHRKAALEQDLAFWYGPRWQEVIPYTPAMQRYVKRLHEVGRTEPELLVAHAYTRYLGDLSGGQVLKKIAQKALDLPSSGEGLAFFTFPNIASATKFKQLYRSRMNSLEMTPAVRQRVIEEAKTAFLLNIQLFEELQELLTHDTKDQSPSRAPGLRQRASNKVQDSAPVETPRGKPPLNTRSQAPLLRWVLTLSFLVATVAVGLYAM

SEQ ID NO: 126 - DNA, 1550 bp, Homo sapiens
  CDS (81)..(944)
tcaacgcctgcctcccctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaaggggtcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctg

SEQ ID NO: 127 - protein, 135 aa, Homo sapiens
MACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 128 - DNA, 507 bp, Homo sapiens
  CDS (50)..(454)
cttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctcccctg

SEQ ID NO: 129 - protein, 662 aa, Homo sapiens
MNKEIPNGNTSELIFNAVHVKDAGFYVCRVNNNFTFEFSQWSQLDVCDIPESFQRSVDGVSESKLQICVEPTSQKLMPGSTLVLQCVAVGSPIPHYQWFKNELPLTHETKKLYMVPYVDLEHQGTYWCHVYNDRDSQDSKKVEIIIGRTDEAVECTEDELNNLGHPDNKEQTTDQPLAKDKVALLIGNMNYREHPKLKAPLVDVYELTNLLRQLDFKVVSLLDLTEYEMRNAVDEFLLLLDKGVYGLLYYAGHGYENFGNSFMVPVDAPNPYRSENCLCVQNILKLMQEKETGLNVFLLDMCRKRNDYDDTIPILDALKVTANIVFGYATCQGAEAFEIQHSGLANGIFMKFLKDRLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKEHLVFTVCLSYQYSGLEDTVEDKQEVNVGKPLIAKLDMHRGLGRKTCFQTCLMSNGPYQSSAATSGGAGHYHSLQDPFHGVYHSHPGNPSNVTPADSCHCSRTPDAFISSFAHHASCHFSRSNVPVETTDEIPFSFSDRLRISEK

SEQ ID NO: 130 - DNA, 2251 bp, Homo sapiens
  CDS (74)..(2059)
cttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcataggaagaacagatgaggcagtggagtgcactgaagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttct

SEQ ID NO: 131 - protein, 824 aa, Homo sapiens
MSLLGDPLQALPPSAAPTGPLLAPPAGATLNRLREPLLRRLSELLDQAPEGRGWRRLAELAGSRGRLRLSCLDLEQCSLKVLEPEGSPSLCLLKLMGEKGCTVTELSDFLQAMEHTEVLQLLSPPGIKITVNPESKAVLAGQFVKLCCRATGHPFVQYQWFKMNKEIPNGNTSELIFNAVHVKDAGFYVCRVNNNFTFEFSQWSQLDVCDIPESFQRSVDGVSESKLQICVEPTSQKLMPGSTLVLQCVAVGSPIPHYQWFKNELPLTHETKKLYMVPYVDLEHQGTYWCHVYNDRDSQDSKKVEIIIGRTDEAVECTEDELNNLGHPDNKEQTTDQPLAKDKVALLIGNMNYREHPKLKAPLVDVYELTNLLRQLDFKVVSLLDLTEYEMRNAVDEFLLLLDKGVYGLLYYAGHGYENFGNSFMVPVDAPNPYRSENCLCVQNILKLMQEKETGLNVFLLDMCRKRNDYDDTIPILDALKVTANIVFGYATCQGAEAFEIQHSGLANGIFMKFLKDRLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKEHLVFTVCLSYQYSGLEDTVEDKQEVNVGKPLIAKLDMHRGLGRKTCFQTCLMSNGPYQSSAATSGGAGHYHSLQDPFHGVYHSHPGNPSNVTPADSCHCSRTPDAFISSFAHHASCHFSRSNVPVETTDEIPFSFSDRLRISEK

SEQ ID NO: 132 - DNA, 2828 bp, Homo sapiens
  CDS (165)..(2636)
ggggcggggagcggacttcctcctctgagggccgtgccgcgctgccagatttgttcttccgcccctgcctccgcggctcggaggcgagcggaaggtgccccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggaataaagattactgtaaacccagagtcaaaggcagtcttggctggacagtttgtgaaactgtgttgccgggcaactggacatccttttgttcaatatcagtggttcaaaatgaataaagagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtgccttatgtggatttggaacaccaaggaacctactggtgtcatgtatataatgatcgagacagtcaagatagcaagaaggtagaaatcatcataggaagaacagatgaggcagtggagtgcactgaagatgaattaaataatcttggtcatcctgataataaagagcaaacaactgaccagcctttggcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatgggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaagaaatgactacgatgataccattccaatcttggatgcactaaaagtcaccgccaatattgtgtttggatatgccacgtgtcaaggagcagaagcttttgaaatccagcattctggattggcaaatggaatctttatgaaatttttaaaagacagattattagaagataagaaaatcactgtgttactggatgaagttgcagaagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatgaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgatctagatattgatccaaaagatgcaaataaaggcacacctgaagaaactggcagctacttggtatcaaaggatcttcccaagcattgcctctataccagactcagttcactgcaaaaattaaaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttct

SEQ ID NO: 133 - protein, 919 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 134 - DNA, 3612 bp, Homo sapiens
  CDS (427)..(3183)
acggcctcgcggagccggcccggcggaccgtgacgggtcccctcacctcctcttctctcccctccccgcccgccctctctccctcccttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttggatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggc

SEQ ID NO: 135 - protein, 382 aa, Homo sapiens
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEEIIKKQGEGVPDLVHVMRTLASENIPSLPPGGELASKRNVIEAVYNRLNPYKNDDTDSTSTDDMW

SEQ ID NO: 136 - DNA, 2467 bp, Homo sapiens
  CDS (444)..(1589)
acgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccggacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataagggaagtcgagacaacatgagtgtgattttgatctgttttccaaatgcacccaaagtatcgccagaagcagtgaagaaggaggcagagttggacaagtacctggaatgcagagtagaagaaatcataaagaagcagggggaaggcgtccccgacttagtccatgtgatgcgcacattagcgagtgagaacatccccagcctcccaccagggggtgaattggcaagcaagaggaatgttattgaagccgtttacaatagactgaatccttacaaaaatgacgacactgactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgattttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaactt

SEQ ID NO: 137 - protein, 358 aa, Homo sapiens
MMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSGPPSAPAEDRSGTPDSIASSSSAAHPPGVQPQQPPYTGAQTQAGQMYQQYQQQAGYGAQQPQAPPQQPQQYGIQYSASYSQQTGPQQPQQFQGYGQQPTSQAPAPAFSGQPQQLPAQPPQQYQASNYPAQTYTAQTSQPTNYTVAPASQPGMAPSQPGAYQPRPGFTSLPGSTMTPPPSGPNPYARNRPPFGQGYTQPGPGYR

SEQ ID NO: 138 - DNA, 1519 bp, Homo sapiens
  CDS (11)..(1084)
attagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagatgtaccaacagtaccagcaacaggccggctatggtgcacagcagccgcaggctccacctcagcagcctcaacagtatggtattcagtattcagcaagctatagtcagcagactggaccccaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatcc

SEQ ID NO: 139 - protein, 396 aa, Homo sapiens [sequence omitted]

SEQ ID NO: 140 - DNA, 1641 bp, Homo sapiens
  CDS (19)..(1206)
aacatcctggagtccaccatgaacggacagttggatctaagtgggaagctaatcgtcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagatgtaccaacagtaccagcaacaggccggctatggtgcacagcagccgcaggctccacctcagcagcctcaacagtatggtattcagtattcagcaagctatagtcagcagactggaccccaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatcc

SEQ ID NO: 141 - protein, 323 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 142 - DNA, 1616 bp, Homo sapiens
  CDS (72)..(1040)
aagtcgttccctctacaaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcac

SEQ ID NO: 143 - protein, 136 aa, Homo sapiens
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMALSCGFLDQRHGHLSVCLLTVAFGGRFLQPLMHCV

SEQ ID NO: 144 - DNA, 1252 bp, Homo sapiens
  CDS (225)..(632)
acaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaaactacccaagtaagatttactgtattaaatggccttcgggtctgaaaagcttttttaacctcttgcttaaaatgcgttttattttgataagatacttcaaatagcctccaaaagtgtagatccaatcacttaaataaacctgtatgtatatgc

SEQ ID NO: 145 - protein, 468 aa, Homo sapiens
MPVRTITRQNGSCLGDPIIVTRSETLKRQFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGMQLPCKSREDCALFVSELYQELFSASKYSFINDNAASGI

SEQ ID NO: 146 - DNA, 1943 bp, Homo sapiens
  CDS (379)..(1782)
acaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtatt

SEQ ID NO: 147 - protein, 460 aa, Homo sapiens
MPVRTITRQNGSCLGDPIIVTRSETLKRQFQGKLKPMTSCFLFTFPSPMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGITVQVNSAFFTGIYGMWNLYVFALMFLYAPSHKNYGEDQSNGMQLPCKSREDCALFVSELYQELFSASKYSFINDNAASGI

SEQ ID NO: 148 - DNA, 1919 bp, Homo sapiens
  CDS (376)..(1755)
atcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtatgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcatcacagtccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtattgtc

SEQ ID NO: 149 - protein, 183 aa, Homo sapiens
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 150 - DNA, 1562 bp, Homo sapiens
  CDS (120)..(668)
tacggctgcgagaagacgacagaaggggattaagagggagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctccgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttctttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctc

SEQ ID NO: 151 - DNA, 2815 bp, Mus musculus
  CDS (192)..(2387)
tctctcctcctcctccagcagccaccagggaccgggagatctaccagctcaagacccctacagccaggtctgtgctgccgccctccagcatctttgcagcaggggacgaggctgtgtgggaggctgtcggttcggaacatgtctccacccaccccaccctctgtggctccaggcttcattctcccccatccatggataacccagggccttcgctccgtggtgcctttggcattctaggtgccttggaaagggacaggctgacccacctgaaacacaagctggggagtctgtgttcaggcagccaggagtcaaagcttctccatgccatggtactcctggctctgggccaggacacggaggccagggtctctctggagtccttgaagatgaacacagtagcccagctggtagcccaccagtgggcagacatggagaccacagagggccctgaggagcctccagacttgtcctggacggtggctcgcctgtaccacctgctggctgaggagaacctgtgtccggcctctacaagggacatggcttaccaggtggcccttcgtgactttgcctcccagggtgaccaccagctgggccaactccagaatgaggcctgggatcggtgcagttcagatatcaagggggaccccagtggtttccagccactccattctcatcagggttccctgcagccaccttcagcatcccctgcagtgaccagaagccagcctcgtcccattgacacaccagactggagttggggacatacgttacactccaccaacagcactgcctcactggccagccacctagagatcagccagtcacccactcttgcctttctctcttcacaccatggaacccatgggcccagcaagctatgtaacacaccgctggacactcaggagcctcagcttgtccctgaaggctgccaagaacctgaggagataagctggcctccatcagtggagaccagtgtctccttagggttaccacacgaaattagcgttccagaggtgtctccagaggaggcttcgcccatcctccctgacgccctggctgctccagacacaagtgtccactgtcccattgaatgcacagagttgtctacaaactccaggtctcccctgacgtccaccacagaaagtgttggaaagcagtggcctattacaagtcagaggtcacctcaggttcctgtaggagatgattctctgcagaacaccacgtcatccagccctcctgcccagccaccatccctccaagcctcccctaagctgcctccttcccctctgtcctctgcttcctccccgagcagctaccctgctcctccaacctccacatcccctgttttggaccactcagaaacatctgatcagaaattctataactttgtggttatccatgccagggctgatgaacaggtggccctacgtattcgggagaagctggagaccctcggggtacctgacggggccaccttctgtgaggaatttcaggtgcccgggcgtggtgagctgcactgtctccaagatgccatcgatcactcggggttcacgatcctgctcctgactgctagctttgattgcagcctgagcctgcatcaaatcaaccatgctctcatgaacagccttacacagtctgggaggcaggactgtgtgatccccctcctcccacttgagtgttcccaggcccagctcagcccagatacaaccagactgctccacagcattgtgtggctggatgaacactccccaatcttcgccagaaaggtggcaaacaccttcaagacacagaagctccaggcacagcgggtacgctggaagaaagcgcaggaggccagaaccctcaaggagcagagcatacagctggaggcagagcggcaaaacgtggcagccatatctgctgcctacacagcctatgtccatagctatagggcctggcaagcagagatgaacaaacttggggtggcttttgggaagaacttgtcactggggactccaacacccagctggcccggatgtccacagccaataccttctcatcctcagggtggtactccagttttcccctattccccacagcctccatccttccctcagcctccatgcttccctcagcctccatccttccctcagcctccatccttcccactgcctccagtctcttccccacagtcccaatcctttccatcagcctcctccccagccccacagactccaggacctcagcctctcattattcaccatgcccagatggttcagctgggtgtcaacaatcacatgtggggccacacaggggcccagtcatctgatgacaagactgagtgttcggagaacccctgtatgggccctctgactgatcagggcgaaccccttcttgagactccagagtgaccaggttggaccccacctagatggctagagtgacaagattggacttcacctgggtccttaaaatgatagtggaggaagggaacctcgcctgggtccccagagtagccagaggacttagcttgggctcccacagtggctattagttggacccagcttgagaccccagaggcagggaagaccacacctataaatcaggcctgggaaacatgcagaaaccccatttgaacagactgtgggactccaatctgaatcctctatgtggacagaggatgatggggccagaggcacctctgaggtgccctcagcgcagcctcgtaaacttcattcactgtgacacatgctgttcatagggtctctctggggaggatgcggtcccggggcacatagggagggtcctgtttttataataaagttattgacaactg

SEQ ID NO: 152 - protein, 732 aa, Mus musculus
MDNPGPSLRGAFGILGALERDRLTHLKHKLGSLCSGSQESKLLHAMVLLALGQDTEARVSLESLKMNTVAQLVAHQWADMETTEGPEEPPDLSWTVARLYHLLAEENLCPASTRDMAYQVALRDFASQGDHQLGQLQNEAWDRCSSDIKGDPSGFQPLHSHQGSLQPPSASPAVTRSQPRPIDTPDWSWGHTLHSTNSTASLASHLEISQSPTLAFLSSHHGTHGPSKLCNTPLDTQEPQLVPEGCQEPEEISWPPSVETSVSLGLPHEISVPEVSPEEASPILPDALAAPDTSVHCPIECTELSTNSRSPLTSTTESVGKQWPITSQRSPQVPVGDDSLQNTTSSSPPAQPPSLQASPKLPPSPLSSASSPSSYPAPPTSTSPVLDHSETSDQKFYNFVVIHARADEQVALRIREKLETLGVPDGATFCEEFQVPGRGELHCLQDAIDHSGFTILLLTASFDCSLSLHQINHALMNSLTQSGRQDCVIPLLPLECSQAQLSPDTTRLLHSIVWLDEHSPIFARKVANTFKTQKLQAQRVRWKKAQEARTLKEQSIQLEAERQNVAAISAAYTAYVHSYRAWQAEMNKLGVAFGKNLSLGTPTPSWPGCPQPIPSHPQGGTPVFPYSPQPPSFPQPPCFPQPPSFPQPPSFPLPPVSSPQSQSFPSASSPAPQTPGPQPLIIHHAQMVQLGVNNHMWGHTGAQSSDDKTECSENPCMGPLTDQGEPLLETPE

SEQ ID NO: 153 - DNA, 2544 bp, Homo sapiens
  CDS (97)..(2232)
taggggacactgggcgtgcagaaggcggggggcagtgtggaacatgccttcaccacctccagcttctgctgccggaggctgcacccacctgtgcccatggcctgcacaggcccatcacttcctagcgccttcgacattctaggtgcagcaggccaggacaagctcttgtatctgaagcacaaactgaagaccccacgcccaggctgccaggggcaggacctcctgcatgccatggttctcctgaagctgggccaggaaactgaggccaggatctctctagaggcattgaaggccgatgcggtggcccggctggtggcccgccagtgggctggcgtggacagcaccgaggacccagaggagcccccagatgtgtcctgggctgtggcccgcttgtaccacctgctggctgaggagaagctgtgccccgcctcgctgcgggacgtggcctaccaggaagccgtccgcaccctcagctccagggacgaccaccggctgggggaacttcaggatgaggcccgaaaccggtgtgggtgggacattgctggggatccagggagcatccggacgctccagtccaatctgggctgcctcccaccatcctcggctttgccctctgggaccaggagcctcccacgccccattgacggtgtttcggactggagccaagggtgctccctgcgatccactggcagccctgcctccctggccagcaacttggaaatcagccagtcccctaccatgcccttcctcagcctgcaccgcagcccacatgggcccagcaagctctgtgacgacccccaggccagcttggtgcccgagcctgtccccggtggctgccaggagcctgaggagatgagctggccgccatcgggggagattgccagcccaccagagctgccaagcagcccacctcctgggcttcccgaagtggccccagatgcaacctccactggcctccctgatacccccgcagctccagaaaccagcaccaactacccagtggagtgcaccgaggggtctgcaggcccccagtctctccccttgcctattctggagccggtcaaaaacccctgctctgtcaaagaccagacgccactccaactttctgtagaagataccacctctccaaataccaagccgtgcccacctactcccaccaccccagaaacatcccctcctcctcctcctcctcctccttcatctactccttgttcagctcacctgaccccctcctccctgttcccttcctccctggaatcatcatcggaacagaaattctataactttgtgatcctccacgccagggcagacgaacacatcgccctgcgggttcgggagaagctggaggcccttggcgtgcccgacggggccaccttctgcgaggatttccaggtgccggggcgcggggagctgagctgcctgcaggacgccatagaccactcagctttcatcatcctacttctcacctccaacttcgactgtcgcctgagcctgcaccaggtgaaccaagccatgatgagcaacctcacgcgacaggggtcgccagactgtgtcatccccttcctgcccctggagagctccccggcccagctcagctccgacacggccagcctgctctccgggctggtgcggctggacgaacactcccagatcttcgccaggaaggtggccaacaccttcaagccccacaggcttcaggcccgaaaggccatgtggaggaaggaacaggacacccgagccctgcgggaacagagccaacacctggacggtgagcggatgcaggcggcggcactgaacgcagcctactcagcctacctccagagctacttgtcctaccaggcacagatggagcagctccaggtggcttttgggagccacatgtcatttgggactggggcgccctatggggctcgaatgccctttgggggccaggtgcccctgggagccccgccaccctttcccacttggccggggtgcccgcagccgccacccctgcacgcatggcaggctggcacccccccaccgccctccccacagccagcagcctttccacagtcactgcccttcccgcagtccccagccttccctacggcctcacccgcaccccctcagagcccagggctgcaacccctcattatccaccacgcacagatggtacagctggggctgaacaaccacatgtggaaccagagagggtcccaggcgcccgaggacaagacgcaggaggcagaatgaccgcgtgtccttgcctgaccacctggggaacacccctggacccaggcatcggccaggaccccatagagcaccccggtctgccctgtgccctgtggacagtggaagatgaggtcatctgccactttcaggacattgtccgggagcccttcatttaggacaaaacgggcgcgatgatgccctggctttcagggtggtcagaactggatacggtgtttacaattccaatctctctatttctgggtgaagggtcttggtggtgggggtattgctacggtcttttaattataataaatatttattgaatgcttc

SEQ ID NO: 154 - protein, 712 aa, Homo sapiens
MACTGPSLPSAFDILGAAGQDKLLYLKHKLKTPRPGCQGQDLLHAMVLLKLGQETEARISLEALKADAVARLVARQWAGVDSTEDPEEPPDVSWAVARLYHLLAEEKLCPASLRDVAYQEAVRTLSSRDDHRLGELQDEARNRCGWDIAGDPGSIRTLQSNLGCLPPSSALPSGTRSLPRPIDGVSDWSQGCSLRSTGSPASLASNLEISQSPTMPFLSLHRSPHGPSKLCDDPQASLVPEPVPGGCQEPEEMSWPPSGEIASPPELPSSPPPGLPEVAPDATSTGLPDTPAAPETSTNYPVECTEGSAGPQSLPLPILEPVKNPCSVKDQTPLQLSVEDTTSPNTKPCPPTPTTPETSPPPPPPPPSSTPCSAHLTPSSLFPSSLESSSEQKFYNFVILHARADEHIALRVREKLEALGVPDGATFCEDFQVPGRGELSCLQDAIDHSAFIILLLTSNFDCRLSLHQVNQAMMSNLTRQGSPDCVIPFLPLESSPAQLSSDTASLLSGLVRLDEHSQIFARKVANTFKPHRLQARKAMWRKEQDTRALREQSQHLDGERMQAAALNAAYSAYLQSYLSYQAQMEQLQVAFGSHMSFGTGAPYGARMPFGGQVPLGAPPPFPTWPGCPQPPPLHAWQAGTPPPPSPQPAAFPQSLPFPQSPAFPTASPAPPQSPGLQPLIIHHAQMVQLGLNNHMWNQRGSQAPEDKTQEAE

SEQ ID NO: 155 - DNA, 3456 bp, Homo sapiens
  CDS (281)..(3016)
agcattcaaggagctccccaggagaaagagcaagttctgaggagccctctgagcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcttgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagac

SEQ ID NO: 156 - protein, 912 aa, Homo sapiens
MKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 157 - DNA, 3609 bp, Homo sapiens
  CDS (152)..(3169)
agatgaagaccagggagaggaaagggtggacctgaggcccccatggagaagggacgggcaggatgtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagac

SEQ ID NO: 158 - protein, 1006 aa, Homo sapiens
MHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 159 - DNA, 3168 bp, Homo sapiens
  CDS (93)..(3089)
agtgcccggtggcccaggagggcctgggagcccgaagccgtccccgagtcgctcctaggtcactggcgcgatgcgggccgtcctctcggctgatgggttggaagcccagcgaggctagaggccagtcccaaagtctccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccttctgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaagtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacaggcacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggat

SEQ ID NO: 160 - protein, 999 aa, Homo sapiens [sequence omitted]

SEQ ID NO: 161 - DNA, 3168 bp, Homo sapiens
  CDS (93)..(3089)
agtgcccggtggcccaggagggcctgggagcccgaagccgtccccgagtcgctcctaggtcactggcgcgatgcgggccgtcctctcggctgatgggttggaagcccagcgaggctagaggccagtcccaaagtctccaggcatcagggctgcagcccaggagcctcaaggcggcccggcgggcgactggacggccggacaggtcccgagcagccccgcccaacatggacccagacccccaggcgggcgtgcaggtgggcatgcgggtggtgcgcggcgtggactggaagtggggccagcaggacggcggcgagggcggcgtgggcacggtggtggagcttggccgccacggcagcccctcgacacccgaccgcacagtggtcgtgcagtgggaccagggcacgcgcaccaactaccgcgccggctaccagggcgcgcacgacctgctgctgtacgacaacgcccagatcggcgtccggcaccccaacatcatctgtgactgctgcaagaagcacgggctgcgggggatgcgctggaagtgccgtgtgtgcctggactacgacctctgcacgcagtgctacatgcacaacaagcatgagctcgcccacgccttcgaccgctacgagaccgctcactcgcgccctgtcacactgagtccccgccagggcctcccgaggatcccactaaggggcatcttccagggagcgaaggtggtgcgaggccccttctgggagtggggctcacaggatggaggggaagggaaaccgggccgtgtggtggacatccgtggctgggatgtggagacaggccggagtgtggccagcgtgacgtgggctgatggtaccaccaatgtgtaccgtgtgggccacaagggcaaggtggacctcaagtgtgtgggcgaggcagcgggcggcttctactacaaggaccacctcccaaggctcggcaagccggcggagctgcagcgcagggtgagtgctgacagccagcccttccagcacggggacaaggtcaagtgtctgctggacactgatgtcctgcgggagatgcaggaaggccacggcggctggaaccccaggatggcggagtttatcggacagacgggcaccgtgcatcgtatcacggaccgcggggacgtgcgcgtgcagttcaaccacgagacgcgctggaccttccaccccggggcgctcaccaagcaccactccttctgggtgggcgacgtggtccgggtcatcggcgaccttgacacagtgaagcggctgcaggctgggcatggcgagtggacggacgacatggcccctgccctgggccgcgtcgggaaggtggtgaaagtgtttggagacgggaacctgcgtgtagcagtcgctggtcagcggtggaccttcagcccctcctgcctggtggcctaccggcccgaggaggatgccaacctggacgtggccgagcgcgcccgggagaacaaaagctcactgagcgtggccctggacaagcttcgggcccagaagagtgacccagagcacccgggaaggctggtggtggaggtggcgctgggtaacgcagcccgggctctggacctgctgcggaggcgcccagagcaagtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgacgcccactcggacacgcccctgcactccgccatctcggcgggcactggagccagcggcattgtcgaggtcctcacggaggtgccaaacatcgatgttaccgccaccaacagccagggtttcaccctgctgcaccatgcctccctcaagggtcacgcgctagctgtgagaaagattctggctcgggcgcggcagctggtggacgccaagaaggaggacggcttcacggcgctgcatctggctgccctcaacaaccaccgcgaggtggcccagatcctcatccgggagggccgctgtgacgtgaacgtgcgcaaccggaagctgcagtccccgctgcatctcgccgtgcaacaggcccacgtggggctggtgccgctactggtggacgctgggtgcagtgtcaacgccgaggacgaggagggggacacagccctgcacgtggcgctgcagcgtcatcagctgctgcccctggtggctgatggggccgggggggacccagggcccttgcagctgctgtccaggctacaggcctcgggcctccccggcagcgcggagctgacggtgggcgcggcggtcgcctgcttcctggcgctggagggcgccgacgtgagctacaccaaccaccgcggtcggagcccgctggacctggccgccgagggtcgcgtgctcaaggcccttcagggctgcgcccagcgcttccgggagcggcaggcgggcgggggcgcggccccgggccccaggcaaacgctcgggacccccaacaccgtgacgaacctgcacgtgggcgccgcgccggggcccgaggccgctgagtgcctggtgtgctccgagctggcgctgctggtgctgttctcgccgtgccagcaccgcaccgtgtgtgaggagtgcgcgcgcaggatgaagaagtgcatcaggtgccaggtggtcgtcagcaagaaactgcgcccagacggctctgaggtggcgagcgccgcccccgcccccggcccgccgcgccagctggtggaggagctgcagagccgctaccggcagatggaggaacgcatcacctgccccatctgcatcgacagccacatccgcctcgtgttccagtgcggccacggcgcatgcgccccctgcggctccgcgctcagcgcctgccccatctgccgccagcccatccgcgaccgcatccagatcttcgtgtgagccgcgccgtccgccgcgcccgagctgccttcgcgtgcccccgccctgtgttttataaaaagaaagattctcggat

SEQ ID NO: 162 - protein, 999 aa, Homo sapiens
MGWKPSEARGQSQSLQASGLQPRSLKAARRATGRPDRSRAAPPNMDPDPQAGVQVGMRVVRGVDWKWGQQDGGEGGVGTVVELGRHGSPSTPDRTVVVQWDQGTRTNYRAGYQGAHDLLLYDNAQIGVRHPNIICDCCKKHGLRGMRWKCRVCLDYDLCTQCYMHNKHELAHAFDRYETAHSRPVTLSPRQGLPRIPLRGIFQGAKVVRGPFWEWGSQDGGEGKPGRVVDIRGWDVETGRSVASVTWADGTTNVYRVGHKGKVDLKCVGEAAGGFYYKDHLPRLGKPAELQRRVSADSQPFQHGDKVKCLLDTDVLREMQEGHGGWNPRMAEFIGQTGTVHRITDRGDVRVQFNHETRWTFHPGALTKHHSFWVGDVVRVIGDLDTVKRLQAGHGEWTDDMAPALGRVGKVVKVFGDGNLRVAVAGQRWTFSPSCLVAYRPEEDANLDVAERARENKSSLSVALDKLRAQKSDPEHPGRLVVEVALGNAARALDLLRRRPEQVDTKNQGRTALQVAAYLGQVELIRLLLQARAGVDLPDDEGNTALHYAALGNQPEATRVLLSAGCRADAINSTQSTALHVAVQRGFLEVVRALCERGCDVNLPDAHSDTPLHSAISAGTGASGIVEVLTEVPNIDVTATNSQGFTLLHHASLKGHALAVRKILARARQLVDAKKEDGFTALHLAALNNHREVAQILIREGRCDVNVRNRKLQSPLHLAVQQAHVGLVPLLVDAGCSVNAEDEEGDTALHVALQRHQLLPLVADGAGGDPGPLQLLSRLQASGLPGSAELTVGAAVACFLALEGADVSYTNHRGRSPLDLAAEGRVLKALQGCAQRFRERQAGGGAAPGPRQTLGTPNTVTNLHVGAAPGPEAAECLVCSELALLVLFSPCQHRTVCEECARRMKKCIRCQVVVSKKLRPDGSEVASAAPAPGPPRQLVEELQSRYRQMEERITCPICIDSHIRLVFQCGHGACAPCGSALSACPICRQPIRDRIQIFV

SEQ ID NO: 163 - DNA, 4031 bp, Mus musculus
  CDS (91)..(2649)
gttctggtcccggtgagatgctggaagctgctgcggcagccgcaacgcgcccggtcgccgtcccgtcgccaatccccgccgtcccgggccatgatcgcctggcgtctgcccttgtgcgtgctcttggtggcctccgtcgagagccacctgggggccctggggcccaagaacgtctcgcagaaagacgcggagtttgagcgcacctacgcggacgacgtcaacagcgagctggtcaacatctacaccttcaaccacaccgtgacccgcaaccggaccgagggtgtgcgagtgtctgtgaatgtcctgaacaagcagaaaggggcgcctttgctgttcgtggtccgccagaaggaggctgttgtgtccttccaggtgcccctaatccttcgaggactgtatcagcggaagtacctctaccaaaaagtggaacgaactctgtgtcagccccccaccaagaatgagtctgagatccagtttttctatgtggacgtgtctaccctgtcacccgtcaataccacttaccagctccgagtcaaccgtgtggacaattttgtgctcaggactggagagctgtttacctttaataccactgcagcccagccccagtacttcaaatacgagtttcctgatggtgtggactcggtaattgtcaaggtgacctccaagaaggccttcccctgctcagtcatctccatccaggatgtcctgtgccctgtctatgatctggacaacagtgtagccttcattggcatgtaccagacgatgactaagaaggcagccatcactgtgcagcggaaagacttccccagcaacagcttctatgtggtggtggtagtgaagactgaggaccaggcctgcggagggtccttgcccttctacccttttgtggaagatgagccagtggatcaagggcaccgtcagaaaacactgtcagtgctggtctctcaggctgtcacatctgaggcctatgttggtgggatgctcttttgcctgggcatattcttgtccttctacctgctgactgtgctgctggcctgttgggagaactggaggcaaaggaagaagaccttgctggtggccatagaccgagcctgcccagaaagtggtcacgctcgggtcttggctgattcatttcctggcagtgccccttacgagggttacaactatggctcctttgaaaatggttccggatccactgacgggttggttgaaagcgcaggttcaggggacctctcctacagttaccaggggcacgaccagttcaagcggcgccttccctctggccagatgcggcagctgtgcattgccatggaccgctcctttgacgcagtgggtcctcggcctcgactggactccatgagctccgtggaagaggatgactacgacacgctgactgacatcgactcagacaaaaacgtcattcgaaccaagcaatacctctgtgtggctgatctggcacgaaaggacaaacgtgttttgcggaaaaagtaccagatttacttctggaacatagccaccattgcggtcttctacgcacttcctgtggtgcagctggtgatcacctaccagacggtggtgaatgtcacagggaaccaggacatctgctactacaacttcctctgtgcccacccgctgggcaacctcagcgccttcaacaacatcctcagcaacttggggtacatcctgctggggctgctcttcctgctcatcatcctgcagcgagagatcaatcataaccgggccctgctgcggaatgacctctatgctctggagtgtgggatccccaaacactttggtctgttttacgccatgggcacagcactgatgatggaggggctacttagtgcctgttaccacgtctgccccaactacaccaacttccagtttgatacctccttcatgtacatgattgctggcctctgcatgctgaagctctaccagaagcggcacccagatatcaacgccagtgcctacagtgcatatgcctgcttggccatcgtcatcttcttctccgttctgggcgtggtgtttggcaaagggaacacggccttctggattgtcttctccgtcattcacatcatctccaccctgctcctcagcactcagctctattacatgggccgctggaagctggacttcgggatcttccgccgcatcctccatgtgctctacacagactgcatccggcagtgcagcgggcccctttacacggaccgcatggtgcttctggtcatgggcaacattatcaactggtcgctggctgcatacggactcatcatgcgccccaatgactttgcttcctacttgctggcaattggcatctgcaacctgctgctttatttcgccttctacatcatcatgaagctccggagcggcgagaggatcaagctcatccctctgctttgcatcgtctgcacctccgtggtctggggcttcgcgctcttcttcttcttccagggactgagcacgtggcagaaaacccccgcagagtccagggagcacaaccgcgactgcatcctcctcgacttctttgatgaccacgatatctggcacttcctgtcctccattgccatgtttgggtccttcctggttttgctgacgttggatgacgacttggacacagtacagcgggacaagatctatgtcttctagcagcatctgtggtccaggcttcacctcacgggcctagcgcctgcctctgcatcacctgccagttgccacaagaacaccacgggtgtgagtcccagctctgctgcccagcattggatgtcgtggcaagacagcgagattccagcccaggcctgactcaggacagttcctggtggcactgagccttggagttgcctctgcggaggaggaggcctgctccgcattccccagacactggccaaattgctgctttcttctcagtgttgggtcctccccaggaccctagtctgtccatctgtcttgtttatccactggctctccatttgtccctttggagaggaaggtgggaaggcaatgtcctgtcccatttcatgccttgcattctgcccatcccttccctcctctcagcttaggacacacagccctttcttcttcccatgctctgtccaggaccacagtctggtgcctgattctttgtccatcaccaggacctaagctctccctgggtctgtagctggctgctatcactgcccactctgacctgccaggacagatgcaggtaggagactttgggggctggccagctggtgccaggctttcggtgctaaggcctggaaggggcctaggtacgaccctcctccctgacctgtgcttggagctggctcttcagcagtgagggccagcccaagttgagtcttctgatcggggactgaattcagaggccacctcatcccaccagccactagaatgatgccagcactagggttggtgggaagtggcaactcactgtccccttccacaccctcagtcctgccaagccccagatgggggcctctcagtgccattgacactgcccaagaatgtctagaggccacggaacggtgccaagcacacagtcccttttgcctctttcacgggagcaggagtcccagtgcctgtcgtggaaagggaggaacatgccaggtccctgtgtgtccttggccctgtctcaccaaaggactcagggctggtttctgagtttccgtccagtatttagccaagttctgtgttagtcacgtaggcctaagagccttggcgtttacagagtcacccagctctggcccctggccattctggtccttggcgtttacagagtcacccagctccaggcccctggccactttggtacttggttgcccttcacttcaccaggtccattccagatgccaagagtgggccccaggaatgtgtttccttctctccaccatgtttttatagctcttgggctgggagaagaggcgggtctgggtctttgtttctgagctttgttctatgttcctccatgctacggttgcaattgttttctatgaacgagtacattcaataaagacaaccagacctgg

SEQ ID NO: 164 - protein, 853 aa, Mus musculus
MIAWRLPLCVLLVASVESHLGALGPKNVSQKDAEFERTYADDVNSELVNIYTFNHTVTRNRTEGVRVSVNVLNKQKGAPLLFVVRQKEAVVSFQVPLILRGLYQRKYLYQKVERTLCQPPTKNESEIQFFYVDVSTLSPVNTTYQLRVNRVDNFVLRTGELFTFNTTAAQPQYFKYEFPDGVDSVIVKVTSKKAFPCSVISIQDVLCPVYDLDNSVAFIGMYQTMTKKAAITVQRKDFPSNSFYVVVVVKTEDQACGGSLPFYPFVEDEPVDQGHRQKTLSVLVSQAVTSEAYVGGMLFCLGIFLSFYLLTVLLACWENWRQRKKTLLVAIDRACPESGHARVLADSFPGSAPYEGYNYGSFENGSGSTDGLVESAGSGDLSYSYQGHDQFKRRLPSGQMRQLCIAMDRSFDAVGPRPRLDSMSSVEEDDYDTLTDIDSDKNVIRTKQYLCVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLYALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSVIHIISTLLLSTQLYYMGRWKLDFGIFRRILHVLYTDCIRQCSGPLYTDRMVLLVMGNIINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 165 - DNA, 3138 bp, Homo sapiens
  CDS (84)..(2648)
gccgcaacccgtcccggaggtgtcctgtctcctgtcgccgccgccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcggtcaccctcgagtcctggctgattcttttcctggcagttccccttatgagggttacaactatggctcctttgagaatgtttctggatctaccgatggtctggttgacagcgctggcactggggacctctcttacggttaccaggggcacgaccagttcaagcggcgcctcccctctggccagatgcggcagctgtgcattgccatgggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtaagcgggcctcccggccgagccgggtgggtacgtgaaggtagcagctgcctccttccctgtggctgatctggcgtccacaccccaggtgttgctgacactggatgacgacctggatacttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcagt

SEQ ID NO: 166 - protein, 855 aa, Homo sapiens
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESGHPRVLADSFPGSSPYEGYNYGSFENVSGSTDGLVDSAGTGDLSYGYQGHDQFKRRLPSGQMRQLCIAMGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVSGPPGRAGWVREGSSCLLPCG

SEQ ID NO: 167 - DNA, 2815 bp, Homo sapiens
  CDS (56)..(571)
gcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagggacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacgggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctggggaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagttccgcttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggc

SEQ ID NO: 168 - protein, 172 aa, Homo sapiens
MRRQPAKVAALLLGLLLECTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 169 - DNA, 3337 bp, Homo sapiens
  CDS (136)..(1755)
tctcgctgcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagcccctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcggcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcgcttgagcccggaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgggctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttg

SEQ ID NO: 170 - protein, 540 aa, Homo sapiens
MPFAEDKTYKYICRNFSNFCNVDVVEILPYLPCLTARDQDRLRATCTLSGNRDTLWHLFNTLQRRPGWVEYFIAALRGCELVDLADEVASVYQSYQPRTSDRPPDPLEPPSLPAERPGPPTPAAAHSIPYNSCREKEPSYPMPVQETQAPESPGENSEQALQTLSPRAIPRNPDGGPLESSSDLAALSPLTSSGHQEQDTELGSTHTAGATSSLTPSRGPVSPSVSFQPLARSTPRASRLPGPTGSVVSTGTSFSSSSPGLASAGAAEGKQGAESDQAEPIICSSGAEAPANSLPSKVPTTLMPVNTVALKVPANPASVSTVPSKLPTSSKPPGAVPSNALTNPAPSKLPINSTRAGMVPSKVPTSMVLTKVSASTVPTDGSSRNEETPAAPTPAGATGGSSAWLDSSSENRGLGSELSKPGVLASQVDSPFSGCFEDLAISASTSLGMGPCHGPEENEYKSEGTFGIHVAENPSIQLLEGNPGPPADPDGGPRPQADRKFQEREVPCHRPSPGALWLQVAVTGVLVVTLLVVLYRRRLH

SEQ ID NO: 171 - DNA, 3579 bp, Homo sapiens
  CDS (242)..(3094)
gtagtttcggctcggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacacagcccagctggagcggcagctgcagttctacacggaggctgcccggcgcctgggcaacgatggcagcagggatgctgcaaaggaggcgctctataggcggaatctggtagggagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggcggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccaggccagcacatggaataaaatagccagggccacactc

SEQ ID NO: 172 - protein, 951 aa, Homo sapiens
MHKRKGPPGPPGRGAAAARQLGLLVDLSPDGLMIPEDGANDEELEAEFLALVGGQPPALEKLKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTPTYSPAPTQPAPRIASAPEPRVTLEGPSATAPASSPGLAKPQMPPGPCSPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPGFPPIQGLEATKPTQQSLVGVLETAMKLANQDEGPEDEEDEVPKKQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNTDSPEFKEQFKLCINRSHRGFRRAIQTKGIKFEVVHKGGLFKTDRVLGTAQLKLDALEIACEVREILEVLDGRRPTGGRLEVMVRIREPLTAQQLETTTERWLVIDPVPAAVPTQVAGPKGKAPPVPAPARESGNRSARPLHSLSVLAFDQERLERKILALRQARRPVPPEVAQQYQDIMQRSQWQRAQLEQGGVGIRREYTAQLERQLQFYTEAARRLGNDGSRDAAKEALYRRNLVGSELQRLRR

SEQ ID NO: 173 - DNA, 2796 bp, Mus musculus
  CDS (574)..(1683)
aagcatttcctattgagacccccaagagttcccccggcggccctcggctccagcaagactttgggccttttcttgtgtcctgtttgttaaaggcatgcgggctccagcattaaagagggctagtccttaacaaagggaaagcgataaatgtaaataagctcacattttcagaatgagcggtttgcagtaaggagctgcggcagcccagagtctgctctttttgggctgggctaacctttccctgttttttgttttttgttttgttttgtttttgttttttatggataaaaatatgcgcttccgaagtgcgagttgccagtttacacgtttattagctaactatctacaggcatgagcacattctctcatctagcacactctttcttgggcactcaattgaggaactctctgatcgtctgcctccagaaaattcattgattatccaagtctcagataaatctggtgccagagtttggtttgaactaactaatgaagaaagcattctctactggtcctcagtctcaagagtggtgaacccctgcacctagcaggctctctgggaaaaaaaaatccatgggtgacagaagatttattgacttccaattccaagatttaaattcaagtctcagacccaggttgggaaatgcaactgccaataatacttgcattgttgatgattccttcaagtataatttgaatggtgctgtctatagtgttgtattcatcctgggtctaataaccaacagtgcctccctgtttgtcttctgcttccgcatgaaaatgagaagtgagacggctactttcatcaccaacctggccctctctgatttgctttttgtttgtaccctacctttcaaaatattttacaactttaatcgccactggccttttggtgacaccctctgtaagatctcagggactgcgttcctcaccaacatctatgggagcatgctcttcctcacctgcatcagtgtggatcgtttcctagccattgtctatcccttccgatcgcgtaccatcaggaccaggaggaattccgccattgtgtgcgctggagtctggatcctagtcctcagtggtggtatttcagcttctttgttctccaccactaatgtcaacaatgcgaccaccacttgctttgaaggcttctccaaacgtgtctggaagacatacctgtccaagatcactatattcattgaagttgttggattcatcattcctctgatattgaatgtttcttgttcttctgtggtgcttagaaccctccgcaagcctgcaacattgtctcagattgggaccaataagaaaaaagtgttgaagatgatcacagtgcatatggcagtgtttgtggtatgctttgtaccatacaactccgttctctttttatatgccttggtacgctcccaagccattactaattgcttattggaaaggtttgcaaagatcatgtacccaattaccttgtgccttgcaactctgaattgttgctttgatccttttatctattacttcactcttgaatcctttcagaagtccttttatatcaatacacatataaggatggagtcgctgtttaagactgagacacctctgacccccaaaccttcccttccagctatccaagaggaagttagtgatcaaacaacaaataatggtggtgaattaatgctggaatccaccttctaggtaccagaattgtctttcaggttcagctacagtgtctcttatgatttttttcctatgctataaataggagaaacaaattgaagctaatgatactgagaatagagtaatgtaccaaatgcagtcagatacatttgtttgaacactattgtacatattctgttttgttcagtaattataggtcaagtctaattacaacaaccaaaacagatcagcctcttctgttgagttgacttttcattacctaaatgaccagtggtcttgacttttagtgatgtgagggttatttttaaacttaaaaaaaaaggcattccagtaattttggtaattgggttgggcctataaatatagaacaaattcagggattatttaaaaacatctgtgttactactgatatatgctagtatttttttccttttttgaattaatattgaatttattttaaaaaaagaactatttttacctaatcttaataagacatactgagaaagagaaatgtgttgaattttaaaatattggcaaattttacctagattttaaaaacctaaatgaagtgtttgaatgaatatgggtgggaaatttggaatttagacaacatttacgcatttataataaccacaattagtgtcagcttttaaaactttctttttaaaataattctagaattttcatatgaaattgttaatcctgaaaggtgctacttatgtgcctggcaggtataaaatggaaaactcataaaattaacagtgtcaatttaaaaaaaaaaaaactttaagcaacactatattatttcttaagattttcatttatcctttatgggggtggggattggcttgtagaaaatatttattcttcatgttaaatgttggggacacattacagccagagagctacagtatttgtgcccaggtcaggagtaaattgaaaaagtaagtgaatagaatagtagcagcaagatatcttagagcttatattagtagtttttaaggtggtggttagatagctgtaattttgaaatccatactctcttctgtacattttggagcacattgtagccaaggcgctgctgaatttgtgctcaggtcgggagcatattgaaaaagatgtgtacat

SEQ ID NO: 174 - protein, 370 aa, Mus musculus
MGDRRFIDFQFQDLNSSLRPRLGNATANNTCIVDDSFKYNLNGAVYSVVFILGLITNSASLFVFCFRMKMRSETATFITNLALSDLLFVCTLPFKIFYNFNRHWPFGDTLCKISGTAFLTNIYGSMLFLTCISVDRFLAIVYPFRSRTIRTRRNSAIVCAGVWILVLSGGISASLFSTTNVNNATTTCFEGFSKRVWKTYLSKITIFIEVVGFIIPLILNVSCSSVVLRTLRKPATLSQIGTNKKKVLKMITVHMAVFVVCFVPYNSVLFLYALVRSQAITNCLLERFAKIMYPITLCLATLNCCFDPFIYYFTLESFQKSFYINTHIRMESLFKTETPLTPKPSLPAIQEEVSDQTTNNGGELMLESTF

SEQ ID NO: 175 - DNA, 2299 bp, Homo sapiens
  CDS (67)..(1176)
cctaccggtccatagtgtcagagtggtgaacccctgcagccagcaggcctcctgaaaaaaaagtccatgggtgacagaagattcattgacttccaattccaagattcaaattcaagcctcagacccaggttgggcaatgctactgccaataatacttgcattgttgatgattccttcaagtataatctcaatggtgctgtctacagtgttgtattcatcttgggtctgataaccaacagtgtctctctgtttgtcttctgtttccgcatgaaaatgagaagtgagactgctatttttatcaccaatctagctgtctctgatttgctttttgtctgtacactaccttttaaaatattttacaacttcaaccgccactggccttttggtgacaccctctgcaagatctctggaactgcattccttaccaacatctatgggagcatgctctttctcacctgtattagtgtggatcgtttcctggccattgtctatccttttcgatctcgtactattaggactaggaggaattctgccattgtgtgtgctggtgtctggatcctagtcctcagtggcggtatttcagcctctttgttttccaccactaatgtcaacaatgcaaccaccacctgctttgaaggcttctccaaacgtgtctggaagacttatttatccaagatcacaatatttattgaagttgttgggtttatcattcctctaatattgaatgtctcttgctcttctgtggtgctgagaactcttcgcaagcctgctactctgtctcaaattgggaccaataagaaaaaagtactgaaaatgatcacagtacatatggcagtctttgtggtatgctttgtaccctacaactctgtcctcttcttgtatgccctggtgcgctcccaagctattactaattgctttttggaaagatttgcaaagatcatgtacccaatcaccttgtgccttgcaactctgaactgttgttttgaccctttcatctattacttcacccttgaatcctttcagaagtccttctacatcaatgcccacatcagaatggagtccctgtttaagactgaaacacctttgaccacaaagccttcccttccagctattcaagaggaagtgagtgatcaaacaacaaataatggtggtgaattaatgctagaatccaccttttaggtatgagaaatgtgttcaggtccagatatggtttctcctataatttttcctatgctataaactaaagatttgaagctaatgatactgagaataatgcaccaaatccagtcagatacatttgtttgaaggtatactgtagagtttttattgctgttttgttcagtaattataggtcaaatctaattacaacaaccaagatggattgccaaactcttctgcttggttggaatttcattgtatcgcattatccaggtggctagtggcatttgataatatagagatgactttgaaactttcaaaaaggtatttctattccaatgatatttggtaattaggttgggcctataaatatagaacaaattcagggatttttaaaaaattgtgttactactgatatatgctagttttattttatttttttggactgtcattgagtttattttagcacaagaatatttttagcctaacattattaataagaaatgtgtcaaatttttaacattggtaaaatatgttatgtgcattttgaaaacagaaaacaaattgcgttggcatgtacgtgggtgggaagaaaaagaaaattaacaggatttacacaattataatcaccagcagtgtgagtttaaaaaacttcgttgtttttacaccaaattaaaattttcatgtcaaacttcaaagccagaaagctgctaaatacgtgtctggcaggtaaaagctggaaaattacttaaaacaggaaagtgtcaataaaaaaacttgagcaacaccaacatattttttcttaaaatgtcacgttatcttcattttgggaaactaggttctataaaatatttatcctccctgttatactttggagcacagcacagccagaaaggggctgcatttgtgcccaggtcaggagcaaattgaaaaaaaaaataaagtaatactaaaaaatcaaactataaacccaaaacatttattaaaacctgaattaatcctttttggagggaggagtagagatatataacctgaaaatacttattctttcttatcgaattttggagcctaatatagccaggagctgctgaatttgtgcccctggattggaaccaaataaaaaaaaaaaaaaaaaattcct

SEQ ID NO: 176 - protein, 370 aa, Homo sapiens
MGDRRFIDFQFQDSNSSLRPRLGNATANNTCIVDDSFKYNLNGAVYSVVFILGLITNSVSLFVFCFRMKMRSETAIFITNLAVSDLLFVCTLPFKIFYNFNRHWPFGDTLCKISGTAFLTNIYGSMLFLTCISVDRFLAIVYPFRSRTIRTRRNSAIVCAGVWILVLSGGISASLFSTTNVNNATTTCFEGFSKRVWKTYLSKITIFIEVVGFIIPLILNVSCSSVVLRTLRKPATLSQIGTNKKKVLKMITVHMAVFVVCFVPYNSVLFLYALVRSQAITNCFLERFAKIMYPITLCLATLNCCFDPFIYYFTLESFQKSFYINAHIRMESLFKTETPLTTKPSLPAIQEEVSDQTTNNGGELMLESTF

SEQ ID NO: 177 - DNA, 973 bp, Homo sapiens
  CDS (30)..(416)
cagacagcggcgggcgcaggacgtgcactatggctcggggctcgctgcgccggttgctgcggctcctcgtgctggggctctggctggcgttgctgcgctccgtggccggggagcaagcgccaggcaccgccccctgctcccgcggcagctcctggagcgcggacctggacaagtgcatggactgcgcgtcttgcagggcgcgaccgcacagcgacttctgcctgggctgcgctgcagcacctcctgcccccttccggctgctttggcccatccttgggggcgctctgagcctgaccttcgtgctggggctgctttctggctttttggtctggagacgatgccgcaggagagagaagttcaccacccccatagaggagaccggcggagagggctgcccagctgtggcgctgatccagtgacaatgtgccccctgccagccggggctcgcccactcatcattcattcatccattctagagccagtctctgcctcccagacgcggcgggagccaagctcctccaaccacaaggggggtggggggcggtgaatcacctccgaggcctgggtccagggttcaggggaaccttccaaggtgtctggttgccctgcctctggctccagaacagaaagggagcctcacgctggctcacacaaaacagctgacactgactaaggaactgcagcatttgcacaggggaggggggtgccctccttcctagaggccctgggggccaggctgacttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttggggagagtttggaggggagggagaatttattaataaaagaatctttaacttt

SEQ ID NO: 178 - protein, 129 aa, Homo sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 179 - DNA, 3631 bp, Homo sapiens
  CDS (191)..(3244)
tctaaatcagcggccgctgaattctagggcgctgctggcgctgcagctgcacttgctccgggcgctggcgcaagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctgtctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagtgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcagatgagacatcaaggtgttggattacctgccgaggtcacacagccaagccatgaagccggattggagcctgcaaacctcggaagtctgtggctgctcagcctggtgtattggtgttacagccagaaactttgggaattctcttgttagttggttagttttactgtaattttctataaagaattcatatcatctgttaatggcgacagtttttgtttcttcctttgaattttttatattctttctttctcttttttgtttcttcttctttgagtattttgtaatcttactgggagggctaaagcgtcttctatcatatcgaattgggacaatgatagaagacaatctttgttttgtcactctaaagaaattattgtaagattttatcatcaggtatgacatttacaccattgatgtaggctttttaaaaaatatatccagcctgtattgggttaagatgattcttttctgatcctgatttcctaggagttggtttttttttttttaaagcataaataaatttaattgcatcag

SEQ ID NO: 180 - protein, 1018 aa, Homo sapiens
MRDDSELTTYSSEYKYIIPSLQKLDAGFYRCVVRNRMGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIEPPYFTAEPESRISAEVEETVDIGCQAMGVPLPTLQWYKDAISISRLQNPRYKVLASGGLRIQKLRPEDSGIFQCFASNEGGEIQTHTYLDVTNIAPVFTQRPVDTTVTDGMTAILRCEVSGAPKPAITWKRENHILASGSVRIPRFMLLESGGLQIAPVFIQDAGNYTCYAANTEGSLNASATLTVWNRTSIVHPPEDHVVIKGTTATLHCGATHDPRVSLRYVWKKDNVALTPSSTSRIVVEKDGSLLISQTWSGDIGDYSCEIVSEGGNDSRMARLEVIELPHSPQNLLVSPNSSHSHAVVLSWVRPFDGNSPILYYIVELSENNSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVTAVGTGLVTSSTISSGVPPDLPGAPSNLVISNISPRSATLQFRPGYDGKTSISRWIVEGQMRHQGVGLPAEVTQPSHEAGLEPANLGSLWLLSLVYWCYSQKLWEFSC

SEQ ID NO: 181 - DNA, 20 bp, Artificial Sequence
  Description of Artificial Sequence:Primer
cttctgctctaaaagctgcg

SEQ ID NO: 182 - DNA, 20 bp, Artificial Sequence
  Description of Artificial Sequence:Primer
cgacctgcagctcgagcaca

SEQ ID NO: 183 - DNA, 38 bp, Artificial Sequence
  Description of Artificial Sequence:primer
ctagctagctagaaactactaaaatgtaaatgacatag

SEQ ID NO: 184 - DNA, 36 bp, Artificial Sequence
  Description of Artificial Sequence:primer
cgcaagcttgaaaggttgcagttagaatgtcctttc

SEQ ID NO: 185 - DNA, 21 bp, Artificial Sequence
  Description of Artificial Sequence:synthetic double stranded nucleic acid
  DNA/RNA molecule
guccaggauaucaugaguctt

SEQ ID NO: 186 - DNA, 21 bp, Artificial Sequence
  Description of Artificial Sequence:synthetic double stranded nucleic acid
  DNA/RNA molecule
gacucaugauauccuggactt

SEQ ID NO: 187 - DNA, 21 bp, Artificial Sequence
  Description of Artificial Sequence:synthetic double stranded nucleic acid
  DNA/RNA molecule
gaagucugaagaucuaucctt

SEQ ID NO: 188 - DNA, 21 bp, Artificial Sequence
  Description of Artificial Sequence:synthetic double stranded nucleic acid
  DNA/RNA molecule
ggauagaucuucagacuuctt

SEQ ID NO: 189 - DNA, 21 bp, Artificial Sequence
  Description of Artificial Sequence:synthetic double stranded nucleic acid
  DNA/RNA molecule
gcugaagaagagguguucctt

SEQ ID NO: 190 - DNA, 21 bp, Artificial Sequence
  Description of Artificial Sequence:synthetic double stranded nucleic acid
  DNA/RNA molecule
ggaacaccucuucuucagctt

SEQ ID NO: 191 - DNA, 21 bp, Artificial Sequence
  Description of Artificial Sequence:synthetic double stranded nucleic acid
  DNA/RNA molecule
gaugacacagaugaagccctt

SEQ ID NO: 192 - DNA, 21 bp, Artificial Sequence
  Description of Artificial Sequence:synthetic double stranded nucleic acid
  DNA/RNA molecule
gggcuucaucugugucauctt

SEQ ID NO: 193 - DNA, 21 bp, Artificial Sequence
  Description of Artificial Sequence:synthetic double stranded nucleic acid
  DNA/RNA molecule
gcccucagaguccagaauctt

SEQ ID NO: 194 - DNA, 21 bp, Artificial Sequence
  Description of Artificial Sequence:synthetic double stranded nucleic acid
  DNA/RNA molecule
gauucuggacucugagggctt

SEQ ID NO: 195 - DNA, 21 bp, Artificial Sequence
  Description of Artificial Sequence:synthetic double stranded nucleic acid
  DNA/RNA molecule
gaugacuuugguaucaaactt

SEQ ID NO: 196 - DNA, 21 bp, Artificial Sequence
  Description of Artificial Sequence:synthetic double stranded nucleic acid
  DNA/RNA molecule
guuugauaccaaagucauctt

SEQ ID NO: 197 - DNA, 30 bp, Artificial Sequence
  Description of Artificial Sequence:synthetic DNA
aaaagtccaggatatcatgagtctttttta

SEQ ID NO: 198 - DNA, 30 bp, Artificial Sequence
  Description of Artificial Sequence:synthetic DNA
agcttaaaaaagactcatgatatcctggac

SEQ ID NO: 199 - DNA, 30 bp, Artificial Sequence
  Description of Artificial Sequence:synthetic DNA
aaaagaagtctgaagatctatcctttttta

SEQ ID NO: 200 - DNA, 30 bp, Artificial Sequence
  Description of Artificial Sequence:synthetic DNA
agcttaaaaaaggatagatcttcagacttc

SEQ ID NO: 201 - DNA, 30 bp, Artificial Sequence
  Description of Artificial Sequence:synthetic DNA
aaaagctgaagaagaggtgttcctttttta

SEQ ID NO: 202 - DNA, 30 bp, Artificial Sequence
  Description of Artificial Sequence:synthetic DNA
agcttaaaaaaggaacacctcttcttcagc

SEQ ID NO: 203 - DNA, 30 bp, Artificial Sequence
  Description of Artificial Sequence:synthetic DNA
aaaagatgacacagatgaagccctttttta

SEQ ID NO: 204 - DNA, 30 bp, Artificial Sequence
  Description of Artificial Sequence:synthetic DNA
agcttaaaaaagggcttcatctgtgtcatc

SEQ ID NO: 205 - DNA, 30 bp, Artificial Sequence
  Description of Artificial Sequence:synthetic DNA
aaaagccctcagagtccagaatctttttta

SEQ ID NO: 206 - DNA, 30 bp, Artificial Sequence
  Description of Artificial Sequence:synthetic DNA
agcttaaaaaagattctggactctgagggc

SEQ ID NO: 207 - DNA, 30 bp, Artificial Sequence
  Description of Artificial Sequence:synthetic DNA
aaaagatgactttggtatcaaactttttta

SEQ ID NO: 208 - DNA, 30 bp, Artificial Sequence
  Description of Artificial Sequence:synthetic DNA
agcttaaaaaagtttgataccaaagtcatc

SEQ ID NO: 209 - DNA, 34 bp, Artificial Sequence
  Description of Artificial Sequence:primer
gcgaattcgggcaggaagagggcctatttcccat

SEQ ID NO: 210 - DNA, 44 bp, Artificial Sequence
  Description of Artificial Sequence:primer
gcaagctttttttgtcttctttccacaagatatataaagccaag

SEQ ID NO: 211 - DNA, 32 bp, Artificial Sequence
  Description of Artificial Sequence:primer
cgctcgagccatggaattcgaacgctgacgtc

SEQ ID NO: 212 - DNA, 34 bp, Artificial Sequence
  Description of Artificial Sequence:primer
gcaagctttctcatacagaacttataagattccc

SEQ ID NO: 213 - RNA, 19 nt, Artificial Sequence
  Description of Artificial Sequence:synthetic double stranded nucleic acid
guccaggauaucaugaguc

SEQ ID NO: 214 - RNA, 19 nt, Artificial Sequence
  Description of Artificial Sequence:synthetic double stranded nucleic acid
gacucaugauauccuggac

SEQ ID NO: 215 - RNA, 19 nt, Artificial Sequence
  Description of Artificial Sequence:synthetic double stranded nucleic acid
gaagucugaagaucuaucc

SEQ ID NO: 216 - RNA, 19 nt, Artificial Sequence
  Description of Artificial Sequence:synthetic double stranded nucleic acid
ggauagaucuucagacuuc

SEQ ID NO: 217 - RNA, 19 nt, Artificial Sequence
  Description of Artificial Sequence:synthetic double stranded nucleic acid
gcugaagaagagguguucc

SEQ ID NO: 218 - RNA, 19 nt, Artificial Sequence
  Description of Artificial Sequence:synthetic double stranded nucleic acid
ggaacaccucuucuucagc

SEQ ID NO: 219 - RNA, 19 nt, Artificial Sequence
  Description of Artificial Sequence:synthetic double stranded nucleic acid
gaugacacagaugaagccc

SEQ ID NO: 220 - RNA, 19 nt, Artificial Sequence
  Description of Artificial Sequence:synthetic double stranded nucleic acid
gggcuucaucugugucauc

SEQ ID NO: 221 - RNA, 19 nt, Artificial Sequence
  Description of Artificial Sequence:synthetic double stranded nucleic acid
gcccucagaguccagaauc

SEQ ID NO: 222 - RNA, 19 nt, Artificial Sequence
  Description of Artificial Sequence:synthetic double stranded nucleic acid
gauucuggacucugagggc

SEQ ID NO: 223 - RNA, 19 nt, Artificial Sequence
  Description of Artificial Sequence:synthetic double stranded nucleic acid
gaugacuuugguaucaaac

SEQ ID NO: 224 - RNA, 19 nt, Artificial Sequence
  Description of Artificial Sequence:synthetic double stranded nucleic acid
guuugauaccaaagucauc

What is claimed is:

1. An isolated polynucleotide which comprises a nucleotide sequence encoding a protein that activates NF-κB and which comprises an amino acid sequence represented by SEQ ID NO: 162 or an amino acid sequence 96% identical thereto over the entire length thereof.

2. An isolated polynucleotide comprising a polynucleotide sequence selected from the group consisting of:

(a) a polynucleotide sequence represented by SEQ ID No: 161; and (b) a polynucleotide sequence encoding a protein that activates NF-κB and that hybridizes under stringent conditions with a polynucleotide having a polynucleotide sequence complementary to the polynucleotide sequence of (a).

3. An isolated polynucleotide comprising a polynucleotide sequence selected from the group consisting of:
   (a) a nucleotide sequence represented by a coding region in SEQ ID NO: 161; and
   (b) a nucleotide sequence encoding a protein that activates NF-κB and that hybridizes under stringent conditions with a polynucleotide having a polynucleotide sequence complementary to the polynucleotide sequence of (a).

4. An isolated polynucleotide comprising a nucleotide sequence which encodes a protein that activates NF-κB and has at least 95% identity to a polynucleotide having the sequence of the coding protein of SEQ ID NO: 161 over the entire length thereof.

5. The isolated polynucleotide of claim 1 that encodes a polypeptide comprising the amino acid sequence of SEQ ID NO: 162.

6. A recombinant vector which comprises a polynucleotide according to any one of claims 1 to 5.

7. A transformed cell which comprises the recombinant vector according to claim 6.

8. A process for producing a protein comprising,
   (a) culturing a transformed cell comprising the isolated polynucleotide according to any one of claims 1 to 5 under conditions providing expression of the encoded protein; and
   (b) recovering the protein from the culture product.

9. A method for screening compounds in respect of activity to inhibit or promote NF-κB activation, which comprises the step of:
   (a) providing a cell with a gene comprising a polynucleotide according to claim 1, 2, or 3 encoding a protein that activates NF-κB, and a component that provides a detectable signal associated with activation of NF-κB;
   (b) culturing a transformed cell under conditions that permit the expression of the gene in the transformed cell;
   (c) contacting the transformed cell with one or more compounds;
   (d) measuring the detectable signal; and
   (e) isolating or identifying an activator compound and/or an inhibitor compound by measuring the detectable signal.

* * * * *